US012035666B2

(12) United States Patent
Kelliher et al.

(10) Patent No.: US 12,035,666 B2
(45) Date of Patent: Jul. 16, 2024

(54) HAPLOID INDUCTION COMPOSITIONS AND METHODS FOR USE THEREFOR

(71) Applicant: Syngenta Participations AG, Basel (CH)

(72) Inventors: Timothy Kelliher, Research Triangle Park, NC (US); Satya Chintamanani, Slater, IA (US); Brent Delzer, Janesville, WI (US); Michael L Nuccio, Durham, NC (US); Robert Arthur Dietrich, Research Triangle Park, NC (US); Suresh Babu Kadaru, Hydrabad (IN); Todd Lee Warner, Stanton, MN (US); William Paul Bullock, Slater, IA (US)

(73) Assignee: Syngenta Participations AG, Basel (CH)

( * ) Notice: Subject to any disclaimer, the term of this patent is extended or adjusted under 35 U.S.C. 154(b) by 0 days.

(21) Appl. No.: 17/691,549

(22) Filed: Mar. 10, 2022

(65) Prior Publication Data
US 2022/0192120 A1    Jun. 23, 2022

Related U.S. Application Data

(62) Division of application No. 17/745,515, filed on Dec. 21, 2021, now Pat. No. 11,840,697, which is a division of application No. 16/218,529, filed on Dec. 13, 2018, now Pat. No. 10,954,523, which is a division of application No. 15/586,649, filed on May 4, 2017, now Pat. No. 10,190,125, which is a division of application No. 14/212,504, filed on Mar. 14, 2014, now Pat. No. 9,677,082.

(60) Provisional application No. 61/852,428, filed on Mar. 15, 2013.

(51) Int. Cl.
| | | |
|---|---|---|
| A01H 1/08 | (2006.01) | |
| A01H 1/04 | (2006.01) | |
| C12N 9/18 | (2006.01) | |
| C12N 15/82 | (2006.01) | |
| C12Q 1/6895 | (2018.01) | |

(52) U.S. Cl.
CPC .............. *A01H 1/08* (2013.01); *A01H 1/045* (2021.01); *C12N 9/18* (2013.01); *C12N 15/8218* (2013.01); *C12N 15/8247* (2013.01); *C12N 15/8261* (2013.01); *C12N 15/8287* (2013.01); *C12Q 1/6895* (2013.01); *C12Y 301/01002* (2013.01); *C12N 2310/14* (2013.01); *C12N 2310/20* (2017.05); *Y02A 40/146* (2018.01)

(58) Field of Classification Search
CPC ........................................................ A01H 1/08
USPC ....................................................... 800/285
See application file for complete search history.

(56) References Cited

U.S. PATENT DOCUMENTS

| | | | |
|---|---|---|---|
| 7,411,117 B2 | 8/2008 | Bohning | |
| 9,677,082 B2 | 6/2017 | Chintamanani et al. | |
| 10,190,125 B2 | 1/2019 | Chintamanani et al. | |
| 2006/0123505 A1* | 6/2006 | Kikuchi | ............... C07K 14/415 536/23.6 |
| 2015/0184194 A1 | 7/2015 | Bidney et al. | |

FOREIGN PATENT DOCUMENTS

| | | |
|---|---|---|
| WO | 201230893 A1 | 3/2012 |
| WO | 2016177887 A1 | 11/2016 |

OTHER PUBLICATIONS

Alexandrov et al. (Plant Mol. Biol. 69 (1-2), 179-194 (Year: 2009).*
Colliver et al, 1997, "Differential Modification of Flavonoid and Isoflavonoid Biosynthesis with an Antisense Chalcone Synthase Construct in Transgenic Lotus Corniculatus", Plant Molecular Bioogy 35, pp. 509-522.
EMBO "Hybrid Plant Breeding: Secrets Behind Haploid Inducers, A Powerful Tool in Maize Breeding", pp. 1-3, Feb. 22, 2017.
Thomas et al, "Size constraints for targeting post-transcriptional gene silencings and for RNA-directed methylation in Nicotiana benthamiana using a potatio virus X vector", The Plant Journal Issue 25, vol. 4, pp. 417-425.
Mbrah et al., Hereditas, "Antisense RNA Inhibition of uidA Gene Expression in Transgenic Plants: Evidence for Interaction Between First and Second Trnasformation Events", vol. 118, pp. 273-280, 1993.
Dong et al., "Fine mapping of qhir1 influencing in vivo haploid induction in maize.", Theor. Appl. Genet. vol. 126: 2013, pp. 1713-1720.
Kelliher et al., "Unresolved issues in pre-meiotic anther development", Frontiers in Plant Science, Plant Evolution and Development, published Jul. 21, 2014, vol. 5, Article 341, pp. 1-9.
Qiu et al., "Morphological, cellular and molecular evidences of chromosomerandom elimination in vivo upon haploid induction in maize", Current Plant Biology 1 (2014) pp. 83-90.

(Continued)

*Primary Examiner* — Li Zheng
(74) *Attorney, Agent, or Firm* — Amanda W. Bublitz

(57) ABSTRACT

Provided here are methods of using a mutated patatin-like phospholipase IIα ("pPLAIIα," renamed here MATRILINEAL) to induce haploid induction in plants, cloning a pPLAIIα to induce haploid induction in plants, and genetically engineering a plant to contain a mutated pPLAIIα. Also provided are methods of applying topical and spray chemicals, lipids, and RNAi molecules to plants during pollination in order to induce haploid production. Further provided are methods of chemically treating plants during pollination to induce haploids while also reducing embryo abortion and increasing seed set.

1 Claim, 16 Drawing Sheets

Specification includes a Sequence Listing.

(56) References Cited

OTHER PUBLICATIONS

Schnable et al., "The B73 Maize Genome: Complexity, Diversity, and Dynamics", Downloaded from www.sciencemag.org on Nov. 16, 2015, Science Magizine, vol. 326, Nov. 20, 20019.
Hu et al., "The Genetic Basis of Haploid Induction in Maize Identified with a Novel Genome-Wide Association Method", Genetics, vol. 202, pp. 1267-1276, Apr. 2016.

* cited by examiner

FIG. 8.

HAPLOID INDUCTION COMPOSITIONS AND METHODS FOR USE THEREFOR

STATEMENT OF PRIORITY

This application is a divisional of U.S. Application No. 17/174,515, now U.S. Pat. No. 11,840,697, and claims the benefit thereof under 35 U.S.C. § 120 and 37 C.F.R. § 1.53(b), which is a divisional of U.S. application Ser. No. 16/218,529, now U.S. Pat. No. 10,954,523, and claims the benefit thereof under 35 U.S.C. § 120 and 37 C.F.R. § 1.53(b), which is a divisional of U.S. application Ser. No. 15/586,649, now U.S. Pat. No. 10,190,125 and claims the benefit thereof under 35 U.S.C. § 120 and 37 C.F.R. § 1.53(b), which is a divisional of U.S. application Ser. No. 14/212,504, now U.S. Pat. No. 9,677,082, which itself claims the benefit, under 35 U.S.C. § 119(e), of U.S. Provisional Application No. 61/852,428 filed on Mar. 15, 2013, the entire contents of all are incorporated by reference herein.

STATEMENT REGARDING ELECTRONIC FILING OF A SEQUENCE LISTING

A Sequence Listing in ASCII text format, submitted under 37 C.F.R. § 1.821, entitled 80225 DIV5_ST25.txt, 678 kilobytes in size, generated on Jul. 20, 2021 and filed via EFS-Web, is provided in lieu of a paper copy. This Sequence Listing is hereby incorporated herein by reference into the specification for its disclosures.

TECHNICAL FIELD

The presently disclosed subject matter relates to the diagnostic detection of haploid induction (HI) or its absence and/or presence in plants which are, or are not haploid inducers. More particularly, the presently disclosed subject matter relates to nucleic acids that can be employed for inducing HI in plants and/or the biological activities which can be modified in order to produce or prevent HI in either a plant that would otherwise exhibit HI or in a plant that would otherwise not exhibit HI. Even more particularly, the presently disclosed subject matter relates to a nucleic acid molecule that encodes a biologically active molecule as well as methods for using the same to regulate HI in plants.

BACKGROUND

Maize breeders have been crossing inbred parent lines, one acting as a male and one as a female to form hybrid seed. The process of developing inbred parent lines which are substantially homozygous usually required a hybrid cross to be selected and self-pollinated (selfed) for numerous generations to become nearly homozygous. This was a time consuming and expensive process. To shorten the time to develop homozygous inbreds in maize, maize breeders have been using a process of using a haploid inducer line to induce haploid seed on a hybrid parent. The chromosomes of the haploid plants are doubled to form double haploid homozygous inbred lines.

A high haploid induction rate allows a higher frequency of haploid seeds to be formed on the parent plant of interest. The parent plants can be pre-screened with genetic markers associated with desired traits or phenotypic observed traits to enrich the genetic potential of the parent plants. When these desired parent plants are pollinated by a haploid inducer that has a higher haploid induction rate, a higher potential of desired doubled haploids can be obtained with the desired genotype and phenotype.

Although the doubled haploid process resulted in faster production of homozygous inbreds, the volume of doubled haploid inbreds that could be produced was limited. The inducer lines had a low frequency of induction of haploids. A number of known haploid-inducing maize lines exist including but not limited to: stock 6, MHI (Moldovian Haploid Inducer), indeterminate gametophyte (ig) mutation, KEMS, RWK, ZEM, ZMS, KMS. The standard inducer lines such as Stock 6 were inducing only 1-3% haploid seeds. Induction of haploids was a rate limiting step in the process of producing doubled haploid lines.

Haploid induction (HI) is a class of plant phenomena characterized by loss of the male inducer chromosomes during embryo development. WO2012/030893 describes a slightly different region of chromosome (1) that is found responsible for haploid induction. The identified markers in the region responsible for haploid induction and increased haploid induction was described as being between 48,249, 509-51,199,249 which is associated with a public marker umc1169 that has the physical position of (60,213,661). This region apparently aligns with the Haploid Induction region in Stock 6. Dong et al. (2013) Theor. Appl. Genet. 126: 1713-1720 describe a QTL located in bin 1.04 which explains up to 66% of the genotypic variance for haploid induction rate.

Haploid induction has been observed in numerous plant species, such as sorghum, rice, and other grasses. The HI appears to be a result of rearrangements of, mutations in, and/or recombinations, insertion, or deletions within a region of chromosome 1. Purported HI-lines have been studied and roughly identified. However, experimental evidence demonstrating a causative genetic agent of HI in maize has not been presented. Nor have the markers listed herein that associate with this trait been previously identified.

The presently disclosed subject matter provides isolated cDNA. In some embodiments, the isolated cDNA are selected from the group consisting of: (a) a nucleic acid having at least 90% identity to SEQ ID NO: 33, SEQ ID NO: 37, SEQ ID NO: 52 or SEQ ID NO: 53, optionally wherein the percent identity is calculated over the entire length of SEQ ID NO: 33, SEQ ID NO: 37, SEQ ID NO: 52 or SEQ ID NO: 53; (b) a nucleic acid having at least 95% identity over nucleotides 91-1452 of SEQ ID NO: 33; (c) a nucleic acid that is the reverse complement of either of (a) or (b); and (d) a nucleic acid that encodes a polypeptide comprising an amino acid sequence that is at least 95% identical to SEQ ID NO: 54, or SEQ ID NO: 55, or SEQ ID NO: 56, or SEQ ID NO: 57 optionally wherein the percent identity is calculated over the entire length of SEQ ID NO: 54, or SEQ ID NO: 55, or SEQ ID NO: 56, or SEQ ID NO: 57.

In other embodiments, a synthetic hairpin nucleic acid construct comprising between 15 and 1000 nucleotides from SEQ ID NO. 33, 37, 52 or 53 and the antisense-complement thereof, such that the first and the second polynucleotide sequences hybridize when transcribed into a ribonucleic acid to form the hairpin-like double stranded ribonucleotide molecule. In further embodiments, the synthetic hairpin nucleic acid construct is selected from the group consisting of SEQ ID NO: 60 and SEQ ID NO: 61.

In other embodiments, an expression cassette for RNAi comprises a promoter operably linked to the synthetic hairpin. In further embodiments, the promoter is a constitutive promoter, optionally a maize ubiquitin-1 promoter, a rice actin-1 promoter, a rice ubiquitin-3 promoter, a rice alpha tubulin (tubA1) promoter, a cauliflower mosaic virus (CaMV) 35S promoter, a cestrum yellow leaf curling virus (CmYLCV) CMP promoter, a super MAS promoter, a sorghum ubiquitin-3 promoter, or a sugarcane ubiquitin-4 promoter. In other embodiments, the promoter is a stamen-, anther-, and/or pollen-specific promoter, optionally selected from the group consisting of SEQ ID NO: 58, a *Triticum aestivum* P19 promoter, a maize B200 promoter, a maize prCDPK-01 promoter, a maize prCDPK-02 prompter, a rice alpha-N-acetylglucosaminidase (prOsANG) promoter, a rice MADS box gene promoter (optional a prOsMADS1 promoter, a prOsMADS2 promoter, a prOsMADS6 promoter, a prOsMADS14 promoter, or a prOsMADS16 promoter), a rice anther specific-promoter (optionally a prRA8 promoter or a prOsG6 promoter). In other embodiments, the expression vector may optionally comprise a terminator. In further embodiments, the terminator may be SEQ ID NO: 59. In some embodiments consist of a plant comprising hairpin nucleic acid construct of the previous embodiments. This plant could be a monocot such as a maize plant.

Some embodiments consist of a method of creating a new haploid inducer plant with a silenced patatin-like phospholipase 2A, comprising transcribing a polynucleotide sequence capable of silencing the patatin-like phospholipase 2A, wherein said polynucleotide sequence is selected from the group consisting of: a polynucleotide sequence comprising the nucleic acid sequence set forth in SEQ ID NOs 33, 37, 52, 53 or the complement thereof, a functional fragment comprising at least 15 contiguous bases of any one of SEQ ID NOs 33, 37, 52, 53 or the complement thereof, a polynucleotide sequence having at least 95% sequence identity as determined using the BLASTN alignment tool to the nucleic acid sequence set forth in any one of SEQ ID NOs 33, 37, 52, 53 or the complement thereof, and a double-stranded ribonucleotide sequence produced from the expression of a polynucleotide sequence of any one of the above polynucleotide sequences, wherein silencing of the patatin-like phospholipase 2A creates a new haploid inducer plant.

Other embodiments are a plant made by the above method. The plant may be a maize plant or other monocot. Other embodiments are a method of inducing haploid embryos by using the pollen of the plant made by the above method to fertilize another plant, wherein the fertilization induces haploid embryos. Other embodiments are a method of identifying a maize plant that comprises a genotype associated with an increased haploid induction phenotype, comprising: isolating DNA from a maize plant, providing a reaction mixture comprising the DNA from a maize plant, the pair of primers comprising SEQ ID NO: 64 and SEQ ID NO 65 wherein the first primer is complementary to a sequence on the first strand of the target DNA and the second primer is complementary to a sequence on the second strand of the target DNA, Taq polymerase, and a plurality of free nucleotides comprising adenine, thymine, cytosine and guanine; heating the reaction mixture to a first predetermined temperature for a first predetermined time to separate the strands of the target DNA from each other; cooling the reaction mixture to a second predetermined temperature for a second predetermined time under conditions to allow the first and second primers to hybridize with their complementary sequences on the first and second strands of the target DNA, and to allow the Taq polymerase to extend the primers; and repeating steps (b) and (c) at least 20 times, wherein an amplification product of about 822 nucleotides indicates a maize plant that comprises a genotype associated with an increased haploid induction phenotype.

Some embodiments consist of an expression cassette for expression of a fertility restoring polypeptide in a plant, the expression cassette comprising an isolated nucleic acid of SEQ ID NO. 33 or 52 operably linked to a promoter that regulates transcription of the isolated nucleic acid of SEQ ID NO. 33 or 52 in a plant cell and/or tissue of interest, wherein the isolated cDNA of claim 1 encodes an amino acid sequence that is at least 95% identical to SEQ ID NO: 54 or 55, optionally wherein the percent identity is calculated over the entire length of SEQ ID NO: 54 or 55.

Other embodiments consist of a kit for detecting the presence of absence of a HI-inducing allele in a plant, the kit comprising one or more nucleic acid- and/or amino acid-based reagents derived from the maize HI locus or from a locus linked thereto wherein the one or more nucleic acid- and/or amino acid-based reagents are designed to be employed in a nucleic acid- and/or amino acid-based assay for the presence or absence in the plant of: a nucleic acid having at least 90% identity to SEQ ID NO: 33, SEQ ID NO: 37, SEQ ID NO: 52 or SEQ ID NO: 53, optionally wherein the percent identity is calculated over the entire length of SEQ ID NO: 33; a nucleic acid having at least 95% identity over nucleotides 91-1452 of SEQ ID NO: 33; a nucleic acid that is the reverse complement of either of (a) or (b); and/or a nucleic acid that encodes a polypeptide comprising an amino acid sequence that is at least 95% identical to SEQ ID NO: 54, SEQ ID NO: 55, SEQ ID NO: 56 or SEQ ID NO: 57 optionally wherein the percent identity is calculated over the entire length of SEQ ID NO: 54, SEQ ID NO: 55, SEQ ID NO: 56 or SEQ ID NO: 57, or nucleic acid comprising nucleotides 1230-1233 of SEQ ID NO: 53.

In some embodiments, the isolated nucleic acids are selected from the group consisting of: a sequence having at least 90% identity to the listed SEQ ID NOs which comprise at least one sequence evidencing an association with a haploid inducing trait by its presence or absence selected from the group consisting of genes identified as GRMZM2G305400, GRMZM2G082836, GRMZM2G382717, GRMZM2G120587, GRMZM2G471240, GRMZM2G866758, and GRMZM2G003530.

The presently disclosed subject matter also provides expression cassettes for expression of the gene products made by the gene which is absent in HI plants. In some embodiments, an expression cassette of the presently disclosed subject matter comprises a nucleic acid sequence as described herein as a synthetic hairpin nucleic acid construct comprising between 15 and 1000 nucleotides from SEQ ID NO: 33, SEQ ID NO: 37, SEQ ID NO: 52 or SEQ ID NO: 53 (such as, but not limited to SEQ ID NO: 60 or 61) operably linked to a promoter that regulates transcription of the isolated nucleic acid in a plant cell and/or tissue of interest, and/or an organelle or subcellular structure thereof. In some embodiments, the isolated nucleic acid present in the expression cassette encodes an amino acid sequence that is at least 95% identical to SEQ ID NO: 54, SEQ ID NO: 55, SEQ ID NO: 56 or SEQ ID NO: 57, optionally wherein the percent identity is calculated over the entire length of SEQ ID NO: 54, SEQ ID NO: 55, SEQ ID NO: 56 or SEQ ID NO: 57. In some embodiments, the promoter is a native promoters associated with the genes within this haploid induction region (such as, but not limited to SEQ ID NO: 58). In some embodiments, constitutive promoter, which can optionally be selected from the group consisting of the native promoter, a constitutive promoter such as ZmUbi1, ZmUbi158, ZmUbi361, SbUbiCh3, SbUbiCh4, a maize ubiquitin-1 promoter, a rice actin-1 promoter, a rice ubiquitin-3 promoter, a cauliflower mosaic virus (CaMV) 35S promoter, a sorghum ubiquitin-3 promoter, or a sugarcane ubiquitin-4 promoter, or a promoter that is pollen specific. Examples of pollen promoters are shown in the art in pollen-specific expression cassettes. Pollen-specific genes have been described for maize (Lopez I, Anthony, R. G., Maciver, S. K., Jaing, C.-J., Khan, S., Weeds, A. G., Hussey, P. J. (1996). Pollen specific expression of maize genes encoding actin depolymerizing factor-like proteins. Proc Natl Acad Sci USA 93:7415-7420.) Such information can be used to identify other maize pollen-specific genes, and promoters and produce pollen-specific expression cassettes. In some embodiments, the expression cassette further comprises a transcription terminator operably linked to the promoter and/or coding sequence. Some embodiments are a promoter for anther, stamen or pollen specific expression comprising SEQ ID NO:58.

In some embodiments, the plant cell and/or tissue of interest is selected from the group consisting of a stamen cell, a microspore, a meiotic cell, a cell that differentiates into a stamen cell or a progeny cell thereof, an anther cell, a cell that differentiates into an anther cell or a progeny cell thereof. In some embodiments, the organelle or subcellular structure of the plant cell and/or tissue of interest is a microspore. Thus, in some embodiments, the promoter is a stamen-, anther-, and/or pollen-specific promoter, which in some embodiments is selected from the group consisting of a *Triticum aestivum* P19 promoter, a maize B200 promoter, a maize prCDPK-01 and prCDPK-02 promoter, a rice α-N-acetylglucosaminidase (prOsANG) promoter, a rice MADS box gene promoter (including, but not limited to a prOsMADS1 promoter, a prOsMADS2 promoter, a prOsMADS6 promoter, prOsMADS7 promoter a prOsMADS14 promoter, or a prOsMADS16 promoter), a rice anther-specific promoter (such as, but not limited to a prRA8 promoter or a prOsG6 promoter), a rice stamen-specific promoter (such as, but not limited to the promoters disclosed in U.S. Pat. No. 5,639,948); and a corn stamen-specific promoter (such as, but not limited to the promoters disclosed in U.S. Pat. No. 5,589,610). In some embodiments, the promoter is a promoter that is transcriptionally active in a plant mitochondrion. Exemplary such promoters include, but are not limited to those disclosed in Fey & Maréchal-Drouard, 1999 and Binder et al., 1996.

In some embodiments, the expression cassette further comprises a transcription terminator, optionally a Nos or ags terminator.

In some embodiments, the expression cassette further comprises a targeting peptide (TP) coding sequence that is operably linked to and in frame with a sequence that encodes an amino acid sequence that is at least 95% identical to SEQ ID NO: 54, SEQ ID NO: 55, SEQ ID NO: 56 or SEQ ID NO: 57.

The presently disclosed subject matter also provides vectors comprising an expression cassette as disclosed herein.

The presently disclosed subject matter also provides transgenic plant cells comprising the presently disclosed expression cassettes, as well as plants, plant parts, and seeds comprising or derived from the presently disclosed transgenic plant cells.

The presently disclosed subject matter also provides isolated polypeptides comprising amino acid sequences that are at least 95% identical to SEQ ID NO: 54, SEQ ID NO: 55, SEQ ID NO: 56 or SEQ ID NO: 57. In some embodiments, the percent identity is calculated over the entire length of SEQ ID NO: 54, SEQ ID NO: 55, SEQ ID NO: 56 or SEQ ID NO: 57. In some embodiments, the isolated polypeptides comprise amino acid sequences that comprise all or substantially all of amino acids 1-429 of SEQ ID NO: 54 locus.

The presently disclosed subject matter also provides subsequences, amplicons, and informative fragments of SEQ ID NO: 33, SEQ ID NO: 37, SEQ ID NO: 52 or SEQ ID NO: 53, as well as allelic variations thereof, wherein the subsequences, amplicons, informative fragments, and/or allelic variations can be used to identify the presence or absence of an allele associated with HI in a plant, or plant tissue, or plant cell.

The presently disclosed subject matter also provides compositions comprising amplification primer pairs capable of amplifying plant nucleic acid templates to generate marker amplicons, wherein the marker amplicons correspond to markers comprising informative subsequences of any of SEQ ID NO: 33, SEQ ID NO: 37, SEQ ID NO: 52 or SEQ ID NO: 53, or of the listed SEQ ID NOs. from this 0.6 MB region which comprise at least one sequence evidencing an association with a haploid inducing trait in this by its presence or absence selected from the group consisting of genes identified as GRMZM2G305400, GRMZM2G082836, GRMZM2G382717, GRMZM2G120587, GRMZM2G471240 (two), GRMZM2G003530, and GRMZM2G866758 (two) wherein the informative subsequences permit identification of the presence or absence of an allele associated with HI in plants. In some embodiments, the amplification primers are designed to amplify a subsequence of SEQ ID NO: 33, SEQ ID NO: 37, SEQ ID NO: 52 or SEQ ID NO: 53 (exemplary primers, but not limited to SEQ ID NO: 64, SEQ ID NO: 65, SEQ ID NO: 66 or SEQ ID NO: 67). The presently disclosed subject matter also provides methods for producing plants that exhibit a new or increased HI trait. In some embodiments, the methods comprise (a) transforming a plant cell with an expression cassette comprising a nucleic acid as disclosed herein to produce a transformed plant cell; and (b) generating a plant from the transformed plant cell.

The presently disclosed subject matter also provides methods for identifying the presence or absence of allele associated with HI in plants. In some embodiments, the methods comprise (a) obtaining a sample from the plant comprising genomic and/or nuclear DNA and/or an RNA product derived therefrom; (b) contacting the sample with a pair of primers that, when used in a nucleic acid amplification reaction with a nucleic acid sample from the plant, produces an amplicon that can be used to identify the presence or absence of an allele associated with HI; (c) amplifying a fragment from said sample using the primer pair of (b), wherein the primer pair is complementary and binds to the nucleotide sequence of (b); and (d) detecting an amplicon that can be used to identify the presence or absence of an allele associated with HI in the plant.

The presently disclosed subject matter also provides methods for introgressing HI-inducing nucleotide sequences or haplotypes into plants. In some embodiments, the methods comprise crossing a first plant with a second plant to produce a third plant, wherein the genome of the first plant or the second plant comprises a nucleic acid sequence (in some embodiments a recombinant nucleic acid sequence) encoding a HI-associated gene product of the presently disclosed subject matter and selecting those plants that do not exhibit production of the gene product, or a gene product at substantially reduced levels. In some embodiments, the methods further comprise assaying the genome of the third plant for the presence or absence of the nucleic acid sequence (in some embodiments, the recombinant nucleic acid sequence) encoding the HI-associated gene product. A HI-associated gene product, can be a negative or positive association. In this instance the association is a negative association, i.e. the presence of the gene product is associated with the absence of the haploid induction trait. In some embodiments, the recombinant nucleic acid comprises SEQ ID NO: 33, SEQ ID NO: 37, SEQ ID NO: 52 or SEQ ID NO: 53, and/or encodes a polypeptide that is at least 95% identical to SEQ ID NO: 54, SEQ ID NO: 55, SEQ ID NO: 56 or SEQ ID NO: 57. In some embodiments, the genome of the third plant that is assayed is the third plant's genome.

The presently disclosed subject matter also provides methods for selecting $F_0$ parental plants predicted to produce haploid inducing plants that exhibit inducible HI traits. In some embodiments, the methods comprise identifying in the genome of an $F_0$ plant the present or absence of a nucleic acid comprising a nucleotide sequence selected from the group consisting of: (a) a nucleic acid having at least 90% identity to SEQ ID NO: 33, SEQ ID NO: 37, SEQ ID NO: 52 or SEQ ID NO: 53, optionally wherein the percent identity is calculated over the entire length of SEQ ID NO: 33, SEQ ID NO: 37, SEQ ID NO: 52 or SEQ ID NO: 53; (b) a nucleic acid having at least 95% identity over nucleotides 1-1452 of SEQ ID NO: 33; (c) a nucleic acid that is the reverse complement of either of (a) or (b); and (d) a nucleic acid that encodes a polypeptide comprising an amino acid sequence that is at least 95% identical to SEQ ID NO: 54, SEQ ID NO: 55, SEQ ID NO: 56 or SEQ ID NO: 57, optionally wherein the percent identity is calculated over the entire length of SEQ ID NO: 54, SEQ ID NO: 55, SEQ ID NO: 56 or SEQ ID NO: 57.

In some embodiments, the methods comprise identifying in the genome of an $F_0$ plant the present or absence of a nucleic acid comprising a nucleotide sequence selected from the group consisting of the listed SEQ ID NOs. 3, 9-46 from this 0.6 MB region which comprise at least one sequence evidencing an association with a haploid inducing trait in this by its presence or absence selected from the group consisting of genes identified as GRMZM2G305400, GRMZM2G082836, GRMZM2G382717, GRMZM2G120587, GRMZM2G471240 (two), and GRMZM2G866758 (two) wherein the nucleic acid has at least 90% identity to the selected SEQ ID NO. optionally wherein the percent identity is calculated over the entire length of the selected SEQ ID NO.

Thus, it is an object of the presently disclosed subject matter to identify and/or introgress and/or provide nucleic acids for inducing and/or inhibiting the HI trait in a plant.

BRIEF DESCRIPTION OF THE FIGURES

FIG. 7A: Pollen tube germination rate was similar in inducers and non-inducers (n=200). FIG. 7B: Initial pollen tube elongation was also similar (n=25). FIG. 7C: RWK but not RWK-NIL is subject to segregation distortion (SD) based on low (25%) trait transmission in germinated progeny (n=300). FIG. 7D: MTL/0 complementation lines also exhibit SD against mtl in germinated progeny (n=400). FIG. 7E: Venn diagram showing RNA-seq profiling results of two haploid inducer-near isogenic pairs (left, RWK versus RWK-NIL; right, NP2222-HI versus NP2222; red text, up-regulated; green text, down-regulated). Only 60 genes were found significantly changed in the same direction.

FIG. 8 shows an amino acid alignment of the maize MTL gene to publically available MTL orthologs in eight grasses, two non-grass monocots, and *Arabidopsis* (thale cress). This alignment includes maize (*Zea mays*, SEQ ID NO: 69), sorghum (*Sorghum bicolor*, 92% sequence identity to MTL, SEQ ID NO: 136), foxtail millet (*Setaria italica*, 85% identity, SEQ ID NO: 137), barley (*Hordeum vulgare*, 78% identity, SEQ ID NO: 138), *Brachypodium distachyon* (78% identity, SEQ ID NO: 139), Indica and *Japonica* variety rice (*Oryza sativa* v. indica (SEQ ID NO: 86) and *japonica* (SEQ ID NO: 140), Os3g27610, 78 and 79% identity, respectively), bread wheat (*Triticum aestivum*, 55% identity, SEQ ID NO: 141), banana (*Musa acuminata*, 57% identity, SEQ ID NO: 142), oil palm (*Elaeis guineesnsis*, 56% identity, SEQ ID NO: 143), and *Arabidopsis thaliana* (52% identity, SEQ ID NO: 144).

BRIEF DESCRIPTION OF THE SEQUENCE LISTING

SEQ ID NO: 1 is a cDNA nucleotide sequence from the maize NIL-genome of SEQ ID NO:3

Figure 1:
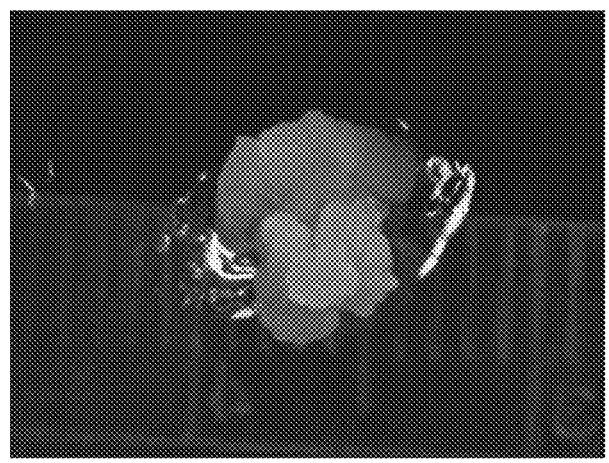
FIG. 1 shows a Maize callus transformed with an *agrobacterium* binary vector carrying the RNAi expression cassette comprising SEQ ID NO: 61 are surviving selection indicating successful transformation.

SEQ ID NO: 2 is an amino acid sequence of a polypeptide encoded by SEQ ID NO: 1 which is a cDNA from the NIL-genome designated GRMZM2G062320-B SEQ ID NO: 3 is the NIL-genome genomic nucleotide sequence SEQ ID NO: 4 is the sequence of ZmABP2-GRMZM2G062320 shown in the vector used in the tissue depicted in FIG. 1.

SEQ ID NOs: 5-8 are amino acid sequences for maize GRMZM2G062320-A, GRMZM2G062320-C, GRMZM2G062320-D, GRMZM2G062320-E SEQ ID NO: 9 GRMZM2G305400 gDNA (from B73 genome)

SEQ ID NO: 10 GRMZM2G305400 cDNA (from B73 genome)

SEQ ID NO: 11 GRMZM2G082836 gDNA (from the B73 genome)

SEQ ID NO: 12 GRMZM2G082836 cDNA1 (from the B73 genome)

SEQ ID NO: 13 GRMZM2G082836 cDNA2 (from the B73 genome)

SEQ ID NO: 14 GRMZM2G082836 cDNA3 (from the B73 genome)

SEQ ID NO: 15 GRMZM2G082836 gDNA (from the NIL genome)

SEQ ID NO: 16 GRMZM2G082836 gDNA (from the Stock 6 genome)

SEQ ID NO: 17 GRMZM2G082836 gDNA (from the RWK genome)

SEQ ID NO: 18 GRMZM2G382717 gDNA (from B73 genome)

SEQ ID NO: 19 GRMZM2G382717 cDNA2 (from B73 genome)

SEQ ID NO: 20 GRMZM2G382717 gDNA (from NIL genome)

SEQ ID NO: 21 GRMZM2G382717 gDNA (from RWK genome)

SEQ ID NO: 22 GRMZM2G382717 gDNA (991832 from Stock 6 genome)

SEQ ID NO: 23 GRMZM2G382717 gDNA (989131 from Stock 6 genome)

SEQ ID NO: 24 GRMZM2G382717 protein coding sequence (from RWK genome)

SEQ ID NO: 25 GRMZM2G120587 gDNA (from the B73 genome)

SEQ ID NO: 26 GRMZM2G120587 cDNA1 (from the B73 genome)

SEQ ID NO: 27 GRMZM2G120587 cDNA2 (from the B73 genome)

SEQ ID NO: 28 GRMZM2G120587 cDNA3 (from the B73 genome)

SEQ ID NO: 29 GRMZM2G120587 GDNA (from the Stock 6 genome)

SEQ ID NO: 30 GRMZM2G120587 GDNA (from the RWK genome)

SEQ ID NO: 31 GRMZM2G120587 GDNA (from the Stock 6/RWK genome)

SEQ ID NO: 32 GRMZM2G471240 gDNA (from the B73 genome)

SEQ ID NO: 33 GRMZM2G471240 cDNA long splice variant (from the B73 genome)

SEQ ID NO: 34 GRMZM2G471240 gDNA (from the NIL genome)

SEQ ID NO: 35 GRMZM2G471240 gDNA (from the maize Stock 6 genome)

SEQ ID NO: 36 GRMZM2G471240 gDNA (from the maize RWK genome)

SEQ ID NO: 37 GRMZM2G471240 cDNA short splice variant (from the Stock6/RWK genome)

SEQ ID NO: 38 GRMZM5G866758 gDNA (from the B73 genome)

SEQ ID NO: 39 GRMZM5G866758 cDNA1 (from the B73 genome)

SEQ ID NO: 40 GRMZM5G866758 cDNA2 (from the B73 genome)

SEQ ID NO: 41 GRMZM5G866758 cDNA-1780 (from the B73 maize genome)

SEQ ID NO: 42 GRMZM5G866758 gDNA (from the NIL maize genome)

SEQ ID NO: 43 GRMZM5G866758 cDNA (from the NIL genome)

SEQ ID NO: 44 GRMZM5G866758 gDNA (from the Stock 6 genome)

SEQ ID NO: 45 GRMZM5G866758 gDNA (from the RWK genome)

SEQ ID NO: 46 GRMZM5G866758 gDNA (from the Stock 6/RWK genome)

SEQ ID NO: 47 GRMZM2G382717 cDNA1 (from B73 genome).

SEQ ID NO: 48 GRMZM2G003530 gDNA (from B73 genome).

SEQ ID NO: 49 GRMZM2G003530 gDNA (from NIL genome).

SEQ ID NO: 50 GRMZM2G003530 gDNA (from RWK genome).

SEQ ID NO: 51 GRMZM2G003530 gDNA (from Stock 6 genome).

SEQ ID NO: 52 GRMZM2G471240 cDNA short splice variant (from the B73 genome)

SEQ ID NO: 53 GRMZM2G471240 cDNA long splice variant (from the RWK genome)

SEQ ID NO: 54 is an amino acid sequence of a polypeptide encoded by SEQ ID NO: 33

SEQ ID NO: 55 is an amino acid sequence of a polypeptide encoded by SEQ ID NO: 52

SEQ ID NO: 56 is an amino acid sequence of a polypeptide encoded by SEQ ID NO: 37

SEQ ID NO: 57 is an amino acid sequence of a polypeptide encoded by SEQ ID NO: 53

SEQ ID NO: 58 is the promoter of the GRMZM2G471240 gene

SEQ ID NO: 59 is the terminator of the GRMZM2G471240 gene

SEQ ID NO: 60 is a synthetic hairpin designed to SEQ ID NO 33 nt 450-547 with 2 mismatches, a spacer sequence and the reverse compliment of SEQ ID NO 33 nt 450-547

SEQ ID NO: 61 is a synthetic hairpin designed to SEQ ID NO 33 nt 797-987 with 2 mismatches, a spacer sequence and the reverse compliment of SEQ ID NO 33 nt 797-987

SEQ ID NO: 62 is the reverse compliment of SEQ ID NO 33

SEQ ID NO: 63 is the reverse compliment of SEQ ID NO 52

SEQ ID NO: 64 is primer rwk.F1

SEQ ID NO: 65 is primer rwk.R1

SEQ ID NO: 66 is primer nil.F1

SEQ ID NO: 67 is primer nil.R1

SEQ ID NO: 68 is the nucleotide sequence of unmutated GRMZM2G471240-NIL.

SEQ ID NO: 69 is the amino acid sequence encoded by SEQ ID NO: 68.

SEQ ID NO: 70 is the nucleotide sequence of GRMZM2G471240-mtl, comprising a 4 base pair insertion, herein renamed matrilineal.

SEQ ID NO: 71 is the amino acid sequence encoded by SEQ ID NO: 70.

SEQ ID NO: 72 is the nucleotide sequence for the TALEN-induced MTL mutation in Event 39A ID 22808-3954 allele 1.

SEQ ID NO: 73 is the nucleotide sequence for the TALEN-induced MTL mutation in Event 23A ID 22808-3924 allele 1.

SEQ ID NO: 74 is the nucleotide sequence for the TALEN-induced MTL mutation in Event 81A ID 22808-3932, Event 81A ID 22808-3317, and Event 81A ID 22808-3303.

SEQ ID NO: 75 is the nucleotide sequence for the TALEN-induced MTL mutation in Event 39A ID 22808-3954 allele 2.

SEQ ID NO: 76 is the nucleotide sequence for the TALEN-induced MTL mutation in Event 23A ID 22808-3924 allele 2.

SEQ ID NO: 77 is the nucleotide sequence for the TALEN-induced MTL mutation in Event 38A ID 22808-4108 allele 1.

SEQ ID NO: 78 is the nucleotide sequence for the CRISPR-induced MTL mutation in Event 18A ID 22807-4016.

SEQ ID NO: 79 is the nucleotide sequence for the CRISPR-induced MTL mutation in Event 27A ID 22807-4073 allele 1.

SEQ ID NO: 80 is the nucleotide sequence for the CRISPR-induced MTL mutation in Event 27A ID 22807-4081 allele 1.

SEQ ID NO: 81 is the nucleotide sequence for the CRISPR-induced MTL mutation in Event 76A ID 22873-3999.

SEQ ID NO: 82 is the nucleotide sequence for the CRISPR-induced MTL mutation in Event 32A ID 22873-3991.

SEQ ID NO: 83 is the nucleotide sequence for a CRISPR guide RNA.

SEQ ID NO: 84 is the nucleotide sequence for Os03g27610, the rice PLA ortholog.

SEQ ID NO: 85 is the cDNA sequence for SEQ ID NO: 84.

SEQ ID NO: 86 is the amino acid sequence encoded by SEQ ID NO: 85.

SEQ ID NO: 87 is the nucleotide sequence of unmutated GRMZM2G471240-B73.

SEQ ID NO: 88 is the nucleotide sequence of unmutated GRMZM2G471240-RWK.

SEQ ID NO: 89 is the nucleotide sequence of unmutated GRMZM2G471240-ST6.

SEQ ID NO: 90 is the amino acid sequence encoded by SEQ ID NO: 87.

SEQ ID NO: 91 is the amino acid sequence encoded by SEQ ID NO: 88.

SEQ ID NO: 92 is the amino acid sequence encoded by SEQ ID NO: 89.

SEQ ID NO: 93 is the nucleotide sequence for the expression cassette of construct 22466.

SEQ ID NO: 94 is the nucleotide sequence for the expression cassette of construct 22467.

SEQ ID NO: 95 is the nucleotide sequence for the expression cassette of construct 22503.

SEQ ID NO: 96 is the nucleotide sequence for the expression cassette of construct 22513.

SEQ ID NO: 97 is the nucleotide sequence for the expression cassette of construct 22807.

SEQ ID NO: 98 is the nucleotide sequence for the expression cassette of construct 22808.

SEQ ID NO: 99 is the nucleotide sequence for the expression cassette of construct 22873.

SEQ ID NO: 100 is the nucleotide sequence for the expression cassette of construct 23123.

SEQ ID NO: 101 is the nucleotide sequence for the expression cassette of construct 23501, rice gRNA target 1 dual guides.

SEQ ID NO: 102 is the nucleotide sequence for the expression cassette of construct 23501, rice gRNA target 1 single guide.

SEQ ID NO: 103 is the nucleotide sequence for the expression cassette of construct 23501, rice gRNA target 2 dual guides.

SEQ ID NO: 104 is the nucleotide sequence for the expression cassette of construct 23501, rice gRNA target 2 single guide.

SEQ ID NO: 105 is the nucleotide sequence for the TALEN-induced MTL mutation in Event 38A ID 22808-4108 allele 2.

SEQ ID NO: 106 is the nucleotide sequence for the CRISPR-induced MTL mutation in Event 27A ID 22807-4073 allele 2.

SEQ ID NO: 107 is the nucleotide sequence for the CRISPR-induced MTL mutation in Event 27A ID 22807-4081 allele 2.

SEQ ID NO: 108 is the nucleotide sequence for TILLING line 1139.

SEQ ID NO: 109 is the nucleotide sequence for TILLING line 3594.

SEQ ID NO: 110 is the nucleotide sequence for TILLING line 0505.

SEQ ID NO: 111 is the nucleotide sequence for TILLING line 2658.

SEQ ID NO: 112 is the nucleotide sequence for TILLING line 1983.

SEQ ID NO: 113 is the nucleotide sequence for TILLING line 2732.

SEQ ID NO: 114 is the nucleotide sequence for TILLING line 2414.
SEQ ID NO: 115 is the amino acid sequence encoded by SEQ ID NO: 108.
SEQ ID NO: 116 is the amino acid sequence encoded by SEQ ID NO: 109.
SEQ ID NO: 117 is the amino acid sequence encoded by SEQ ID NO: 110.
SEQ ID NO: 118 is the amino acid sequence encoded by SEQ ID NO: 111.
SEQ ID NO: 119 is the amino acid sequence encoded by SEQ ID NO: 112.
SEQ ID NO: 120 is the amino acid sequence encoded by SEQ ID NO: 113.
SEQ ID NO: 121 is the amino acid sequence encoded by SEQ ID NO: 114.
SEQ ID NO: 122 is the amino acid sequence encoded by SEQ ID NO: 72.
SEQ ID NO: 123 is the amino acid sequence encoded by SEQ ID NO: 73.
SEQ ID NO: 124 is the amino acid sequence encoded by SEQ ID NO: 74.
SEQ ID NO: 125 is the amino acid sequence encoded by SEQ ID NO: 75.
SEQ ID NO: 126 is the amino acid sequence encoded by SEQ ID NO: 76.
SEQ ID NO: 127 is the amino acid sequence encoded by SEQ ID NO: 77.
SEQ ID NO: 128 is the amino acid sequence encoded by SEQ ID NO: 78.
SEQ ID NO: 129 is the amino acid sequence encoded by SEQ ID NO: 79.
SEQ ID NO: 130 is the amino acid sequence encoded by SEQ ID NO: 80.
SEQ ID NO: 131 is the amino acid sequence encoded by SEQ ID NO: 81.
SEQ ID NO: 132 is the amino acid sequence encoded by SEQ ID NO: 82.
SEQ ID NO: 133 is the amino acid sequence encoded by SEQ ID NO: 105.
SEQ ID NO: 134 is the amino acid sequence encoded by SEQ ID NO: 106.
SEQ ID NO: 135 is the amino acid sequence encoded by SEQ ID NO: 107.
SEQ ID NO: 136 is the amino acid sequence for MTL ortholog found in *Sorghum bicolor*.
SEQ ID NO: 137 is the amino acid sequence for MTL ortholog found in *Setaria italica*.
SEQ ID NO: 138 is the amino acid sequence for MTL ortholog found in *Hordeum vulgare*.
SEQ ID NO: 139 is the amino acid sequence for MTL ortholog found in *Brachypodium distachyon*.
SEQ ID NO: 140 is the amino acid sequence for MTL ortholog found in *Oryza sativa* v. indica.
SEQ ID NO: 141 is the amino acid sequence for MTL ortholog found in *Triticum aestivum*.
SEQ ID NO: 142 is the amino acid sequence for MTL ortholog found in *Musa acuminata*.
SEQ ID NO: 143 is the amino acid sequence for MTL ortholog found in *Elaeis guineensis*.
SEQ ID NO: 144 is the amino acid sequence for MTL ortholog found in *Arabidopsis thaliana*.

DETAILED DESCRIPTION

While the following terms are believed to be well understood by one of ordinary skill in the art, the following definitions are set forth to facilitate explanation of the presently disclosed subject matter.

All technical and scientific terms used herein, unless otherwise defined below, are intended to have the same meaning as commonly understood by one of ordinary skill in the art. References to techniques employed herein are intended to refer to the techniques as commonly understood in the art, including variations on those techniques and/or substitutions of equivalent techniques that would be apparent to one of skill in the art. While the following terms are believed to be well understood by one of ordinary skill in the art, the following definitions are set forth to facilitate explanation of the presently disclosed subject matter.

Following long-standing patent law convention, the terms "a", "an", and "the" refer to "one or more" when used in this application, including the claims. For example, the phrase "a cell" refers to one or more cells, and in some embodiments can refer to a tissue and/or an organ. Similarly, the phrase "at least one", when employed herein to refer to an entity, refers to, for example, 1, 2, 3, 4, 5, 6, 7, 8, 9, 10, 15, 20, 25, 30, 35, 40, 45, 50, 75, 100, or more of that entity, including but not limited to all whole number values between 1 and 100 as well as whole numbers greater than 100.

Unless otherwise indicated, all numbers expressing quantities of ingredients, reaction conditions, and so forth used in the specification and claims are to be understood as being modified in all instances by the term "about". The term "about", as used herein when referring to a measurable value such as an amount of mass, weight, time, volume, concentration or percentage is meant to encompass variations of in some embodiments ±20%, in some embodiments ±10%, in some embodiments ±5%, in some embodiments ±1%, in some embodiments ±0.5%, and in some embodiments ±0.1% from the specified amount, as such variations are appropriate to perform the disclosed methods and/or employ the discloses compositions, nucleic acids, polypeptides, etc. Accordingly, unless indicated to the contrary, the numerical parameters set forth in this specification and attached claims are approximations that can vary depending upon the desired properties sought to be obtained by the presently disclosed subject matter.

As used herein, the term "allele" refers to a variant or an alternative sequence form at a genetic locus. In diploids, a single allele is inherited by a progeny individual separately from each parent at each locus. The two alleles of a given locus present in a diploid organism occupy corresponding places on a pair of homologous chromosomes, although one of ordinary skill in the art understands that the alleles in any particular individual do not necessarily represent all of the alleles that are present in the species.

As used herein, the term "and/or" when used in the context of a list of entities, refers to the entities being present singly or in combination. Thus, for example, the phrase "A, B, C, and/or D" includes A, B, C, and D individually, but also includes any and all combinations and subcombinations of A, B, C, and D (e.g., AB, AC, AD, BC, BD, CD, ABC, ABD, and BCD). In some embodiments, one of more of the elements to which the "and/or" refers can also individually be present in single or multiple occurrences in the combinations(s) and/or subcombination(s).

As used herein, the phrase "associated with" refers to a recognizable and/or assayable relationship between two entities. For example, the phrase "associated with HI" refers to a trait, locus, gene, allele, marker, phenotype, etc., or the expression thereof, the presence or absence of which can influence an extent and/or degree at which a plant or its progeny exhibits HI. As such, a marker is "associated with"

a trait when it is linked to it and when the presence of the marker is an indicator of whether and/or to what extent the desired trait or trait form will occur in a plant/germplasm comprising the marker. Similarly, a marker is "associated with" an allele when it is linked to it and when the presence of the marker is an indicator of whether the allele is present in a plant/germplasm comprising the marker. For example, "a marker associated with HI" refers to a marker whose presence or absence can be used to predict whether and/or to what extent a plant will display haploid induction.

The term "comprising", which is synonymous with "including", "containing", and "characterized by", is inclusive or open-ended and does not exclude additional, unrecited elements and/or method steps. "Comprising" is a term of art that means that the named elements and/or steps are present, but that other elements and/or steps can be added and still fall within the scope of the relevant subject matter.

As used herein, the phrase "consisting of" excludes any element, step, or ingredient not specifically recited. When the phrase "consists of" appears in a clause of the body of a claim, rather than immediately following the preamble, it limits only the element set forth in that clause; other elements are not excluded from the claim as a whole.

As used herein, the phrase "consisting essentially of" limits the scope of the related disclosure or claim to the specified materials and/or steps, plus those that do not materially affect the basic and novel characteristic(s) of the disclosed and/or claimed subject matter.

With respect to the terms "comprising", "consisting essentially of", and "consisting of", where one of these three terms is used herein, the presently disclosed and claimed subject matter can include in some embodiments the use of either of the other two terms. For example, if a subject matter relates in some embodiments to nucleic acids that encode polypeptides comprising amino acid sequences that are at least 95% identical to a SEQ ID NO: 55. It is understood that the disclosed subject matter thus also encompasses nucleic acids that encode polypeptides that in some embodiments consist essentially of amino acid sequences that are at least 95% identical to that SEQ ID NO: 55 as well as nucleic acids that encode polypeptides that in some embodiments consist of amino acid sequences that are at least 95% identical to that SEQ ID NO: 55. Similarly, it is also understood that in some embodiments the methods for the disclosed subject matter comprise the steps that are disclosed herein, in some embodiments the methods for the presently disclosed subject matter consist essentially of the steps that are disclosed, and in some embodiments the methods for the presently disclosed subject matter consist of the steps that are disclosed herein.

As used herein, the term "gene" refers to a hereditary unit including a sequence of DNA that occupies a specific location on a chromosome and that contains the genetic instruction for a particular characteristic or trait in an organism.

A "genetic map" is a description of genetic linkage relationships among loci on one or more chromosomes within a given species, generally depicted in a diagrammatic or tabular form. For each genetic map, distances between loci are measured by the recombination frequencies between them. Recombination events between loci can be detected using a variety of markers. A genetic map is a product of the mapping population, types of markers used, and the polymorphic potential of each marker between different populations. The order and genetic distances between loci can differ from one genetic map to another.

As used herein, the phrase "genetic marker" refers to a nucleic acid sequence (e.g., a polymorphic nucleic acid sequence) that has been identified as associated with a locus or allele of interest and that is indicative of the presence or absence of the locus or allele of interest in a cell or organism. Examples of genetic markers include, but are not limited to genes, DNA or RNA-derived sequences, promoters, any untranslated regions of a gene, microRNAs, siRNAs, QTLs, SNPs, transgenes, mRNAs, ds RNAs, transcriptional profiles, and methylation patterns.

As used herein, the term "genotype" refers to the genetic constitution of an individual (or group of individuals) at one or more genetic loci, as contrasted with the observable and/or detectable and/or manifested trait (the phenotype). Genotype is defined by the allele(s) and/or haplotype(s) of one or more known loci that the individual has inherited from its parents. The term genotype can be used to refer to an individual's genetic constitution at a single locus, at multiple loci, or more generally, the term genotype can be used to refer to an individual's genetic make-up for all the genes in its genome (in some embodiments, including the nuclear genome, the mitochondrial genome, plastid genome or all three). Genotypes can be indirectly characterized, e.g., using markers and/or directly characterized by nucleic acid sequencing.

As used herein, the term "germplasm" refers to genetic material of or from an individual (e.g., a plant), a group of individuals (e.g., a plant line, variety, or family), or a clone derived from a line, variety, species, or culture. The germplasm can be part of an organism or cell, or can be separate from the organism or cell. In general, germplasm provides genetic material with a specific molecular makeup that provides a physical foundation for some or all of the hereditary qualities of an organism or cell culture. As used herein, germplasm includes cells, seed or tissues from which new plants can be grown, as well as plant parts, such as leafs, stems, pollen, or cells that can be cultured into a whole plant.

A "haplotype" is the genotype of an individual at a plurality of genetic loci, i.e., a combination of alleles. Typically, the genetic loci that define a haplotype are physically and genetically linked, i.e., on the same chromosome segment. The term "haplotype" can refer to polymorphisms at a particular locus, such as a single marker locus, or polymorphisms at multiple loci along a chromosomal segment.

As used herein, the terms "informative fragment" and "informative subsequence" refer to nucleotide sequences comprising a fragment of a larger nucleotide sequence, wherein detecting of the presence of absence of the fragment allows for the detecting of the presence of absence of the larger nucleotide sequence. For example, an informative fragment of the nucleotide sequence of SEQ ID NO: 33 comprises a fragment of the nucleotide sequence of SEQ ID NO: 33 that permits the accurate identification of whether or not SEQ ID NO: 33 is present in a sample. This non HI locus lacks the 4 nucleotide insertion that is present in the HI germplasm as found in SEQ ID NO: 53 nucleotides 1230-1233. In some embodiments, an informative fragment of SEQ ID NO: 53 allows identification of the presence or absence of the HI locus. In some embodiments, informative fragments of SEQ ID NO: 53 containing nucleotides 1230-1233 allow identification of the presence or absence of the HI locus.

As used herein, the term "isolated" refers to a nucleotide sequence that is free of sequences that normally flank one or both sides of the nucleotide sequence in a plant genome. Thus, isolated nucleic acids include, without limitation, a recombinant DNA that exists as a separate molecule with no flanking sequences present, as well as a recombinant DNA that is incorporated into a vector, an autonomously replicating plasmid, or into the genomic DNA of a plant as part of a hybrid or fusion nucleic acid molecule.

As used herein, the term "linkage" refers to a phenomenon wherein alleles on the same chromosome tend to be transmitted together more often than expected by chance if their transmission were independent. Thus, two alleles on the same chromosome are said to be "linked" when they segregate from each other in the next generation in some embodiments less than 50% of the time, in some embodiments less than 25% of the time, in some embodiments less than 20% of the time, in some embodiments less than 15% of the time, in some embodiments less than 10% of the time, in some embodiments less than 9% of the time, in some embodiments less than 8% of the time, in some embodiments less than 7% of the time, in some embodiments less than 6% of the time, in some embodiments less than 5% of the time, in some embodiments less than 4% of the time, in some embodiments less than 3% of the time, in some embodiments less than 2% of the time, and in some embodiments less than 1% of the time.

As such, "linkage" typically implies and can also refer to physical proximity on a chromosome. Thus, two loci are linked if they are within in some embodiments 20 centiMorgans (cM), in some embodiments 15 cM, in some embodiments 12 cM, in some embodiments 10 cM, in some embodiments 9 cM, in some embodiments 8 cM, in some embodiments 7 cM, in some embodiments 6 cM, in some embodiments 5 cM, in some embodiments 4 cM, in some embodiments 3 cM, in some embodiments 2 cM, and in some embodiments 1 cM of each other. Similarly, a HI locus of the presently disclosed subject matter is linked to a marker (e.g., a genetic marker) if it is in some embodiments within 20, 15, 12, 10, 9, 8, 7, 6, 5, 4, 3, 2, or 1 cM of the marker.

Thus, the term "linkage" refers to the degree with which one marker locus is associated with another marker locus or some other locus (for example, a locus associated with HI). The linkage relationship between a molecular marker and a phenotype can be given as a "probability" or "adjusted probability." Linkage can be expressed as a desired limit or range. For example, in some embodiments, any marker is linked (genetically and physically) to any other marker when the markers are separated by less than about 50, 40, 30, 25, 20, or 15 map units (or cM).

As used herein, the term "linkage disequilibrium" refers to a non-random segregation of genetic loci or traits (or both). In either case, linkage disequilibrium implies that the relevant loci are within sufficient physical proximity along a length of a chromosome so that they segregate together with greater than random (i.e., non-random) frequency (in the case of co-segregating traits, the loci that underlie the traits are in sufficient proximity to each other). Markers that show linkage disequilibrium are considered linked. Linked loci co-segregate more than 50% of the time, e.g., from about 51% to about 100% of the time. In other words, two markers that co-segregate have a recombination frequency of less than 50% (and, by definition, are separated by less than 50 cM on the same chromosome). As used herein, linkage can be between two markers, or alternatively between a marker and a phenotype. A marker locus can be "associated with" (linked to) a trait, e.g., HI. The degree of linkage of a molecular marker to a phenotypic trait is measured, e.g., as a statistical probability of co-segregation of that molecular marker with the phenotype.

As used herein, the term "linkage equilibrium" describes a situation where two markers independently segregate, i.e., sort among progeny randomly. Markers that show linkage equilibrium are considered unlinked (whether or not they lie on the same chromosome). As such, the phrase "linkage disequilibrium" is defined as change from the expected relative frequency of gamete types in a population of many individuals in a single generation such that two or more loci act as genetically linked loci. If the frequency in a population of allele S is x, s is x', B is y, and b is y', then the expected frequency of genotype SB is xy, that of Sb is xy', that of sB is x'y, and that of sb is x'y', and any deviation from these frequencies is an example of disequilibrium. Linkage disequilibrium is most commonly assessed using the measure r2, which is calculated using the formula described by Hill & Robertson, 1968. When r2=1, complete linkage disequilibrium exists between the two marker loci, meaning that the markers have not been separated by recombination and have the same allele frequency. In some embodiments, values for r2 above 0.33 indicate sufficiently strong linkage disequilibrium to be useful for mapping. See Ardlie et al., 2002. Hence, alleles are in linkage disequilibrium when r2 values between pairwise marker loci are greater than or equal to about 0.33, 0.4, 0.5, 0.6, 0.7, 0.8, 0.9, or 1.0.

As used herein, the terms "marker", "genetic marker", and 'molecular marker" are used interchangeably to refer to an identifiable position on a DNA molecule (e.g., a chromosome or a nuclear genome) the inheritance of which can be monitored and/or a reagent that is used in methods for visualizing differences in nucleic acid sequences present at such identifiable positions on a DNA molecule. Thus, in some embodiments a marker comprises a known or detectable nucleic acid sequence. As such, a marker can comprise a nucleotide sequence that has been associated with an allele or alleles of interest and that is indicative of the presence or absence of the allele or alleles of interest in a cell or organism and/or to a reagent that is used to visualize differences in the nucleotide sequence at such an identifiable position or positions. A marker can be, but is not limited to, an allele, a gene, a haplotype, a restriction fragment length polymorphism (RFLP), a simple sequence repeat (SSR), random amplified polymorphic DNA (RAPD), cleaved amplified polymorphic sequences (CAPS; Rafalski & Tingey, 1993), an amplified fragment length polymorphism (AFLP; Vos et al., 1995), a single nucleotide polymorphism (SNP) (Brookes, 1993), a sequence-characterized amplified region (SCAR; Paran & Michelmore, 1993), a sequence-tagged site (STS; Onozaki et al., 2004), a single-stranded conformation polymorphism (SSCP; Orita et al., 1989), an inter-simple sequence repeat (ISSR; Blair et al., 1999), an inter-retrotransposon amplified polymorphism (TRAP), a retrotransposon-microsatellite amplified polymorphism (REMAP; Kalendar et al., 1999) or an RNA cleavage product (such as a Lynx tag). A marker can be present in genomic (including but not limited to nuclear genomic and/or 1 genomic) or expressed nucleic acids (e.g., ESTs). In some embodiments, a marker is an informative fragment of SEQ ID NO: 33, SEQ ID NO: 37, SEQ ID NO: 52 or SEQ ID NO: 53 that permits the specific identification of nucleic acids comprising or lacking SEQ ID NO: 33, SEQ ID NO: 37, SEQ ID NO: 52 or SEQ ID NO: 53 in samples.

The term marker can also refer to nucleic acids used as probes or primers (e.g., primer pairs) for use in amplifying, hybridizing to, and/or detecting nucleic acid molecules according to methods well known in the art. In some embodiments, a nucleic acid marker that can be employed to detect the presence or absence of SEQ ID NO: 33, SEQ ID NO: 37, SEQ ID NO: 52 or SEQ ID NO: 53 is a primer pair that comprises a forward primer that comprises a subsequence of nucleotides of SEQ ID NO: 33, SEQ ID NO: 37, SEQ ID NO: 52 or SEQ ID NO: 53 and a reverse primer that is the reverse complement of a subsequence of nucleotides of SEQ ID NO: 33, SEQ ID NO: 37, SEQ ID NO: 52 or SEQ ID NO: 53 and/or is an amplicon that is generated by using such a primer pair to amplify a subsequence of SEQ ID NO: 33, SEQ ID NO: 37, SEQ ID NO: 52 or SEQ ID NO: 53 (i.e., the subsequence of SEQ ID NO: 33, SEQ ID NO: 37, SEQ ID NO: 52 or SEQ ID NO: 53 that comprises nucleotides, optionally including 1, 2, 3, 4, 5, 6, 7, 8, 9, 10, or more nucleotides of SEQ ID NO: 33, SEQ ID NO: 37, SEQ ID NO: 52 or SEQ ID NO: 53 that are 5' to and/or 3' to nucleotides selected nucleotides from the positions listed in the Table on Fine Mapping in Example 3 and a part of SEQ ID NO: 1-47).

As used herein, the terms "marker probe" and "probe" refer to a nucleotide sequence or nucleic acid molecule that can be used to detect the presence or absence of sequence within SEQ ID NO: 33, SEQ ID NO: 37, SEQ ID NO: 52 or SEQ ID NO: 53 (e.g., a nucleic acid probe that is complementary to all of or a portion of the marker or marker locus, through nucleic acid hybridization). Marker probes comprising about 8, 10, 15, 20, 30, 40, 50, 60, 70, 80, 90, 100 or more contiguous nucleotides can be used for nucleic acid hybridization.

As used herein, the term "molecular marker" can be used to refer to a genetic marker, as defined above, or an encoded product thereof (e.g., a protein) used as a point of reference when identifying the presence/absence of a HI-associated locus. A molecular marker can be derived from genomic nucleotide sequences or from expressed nucleotide sequences (e.g., from an RNA, a cDNA, etc.). The term also refers to nucleotide sequences complementary to or flanking the marker sequences, such as nucleotide sequences used as probes and/or primers capable of amplifying the marker sequence. Nucleotide sequences are "complementary" when they specifically hybridize in solution (e.g., according to Watson-Crick base pairing rules). This term also refers to the genetic markers that indicate a trait by the absence of the nucleotide sequences complementary to or flanking the marker sequences, such as nucleotide sequences used as probes and/or primers capable of amplifying the marker sequence.

As used herein, the terms "nucleotide sequence", "polynucleotide", "nucleic acid sequence", "nucleic acid molecule", and "nucleic acid fragment" refer to a polymer of RNA or DNA that is single- or double-stranded, optionally containing synthetic, non-natural, and/or altered nucleotide bases. A "nucleotide" is a monomeric unit from which DNA or RNA polymers are constructed and consists of a purine or pyrimidine base, a pentose, and a phosphoric acid group. Nucleotides (usually found in their 5'-monophosphate form) are referred to by their single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide.

As used herein, the term "nucleotide sequence identity" refers to the presence of identical nucleotides at corresponding positions of two polynucleotides. Polynucleotides have "identical" sequences if the sequence of nucleotides in the two polynucleotides is the same when aligned for maximum correspondence (e.g., in a comparison window). Sequence comparison between two or more polynucleotides is generally performed by comparing portions of the two sequences over a comparison window to identify and compare local regions of sequence similarity. The comparison window is generally from about 20 to 200 contiguous nucleotides. The "percentage of sequence identity" for polynucleotides, such as about 50, 55, 60, 65, 70, 75, 80, 85, 90, 95, 98, 99 or 100 percent sequence identity, can be determined by comparing two optimally aligned sequences over a comparison window, wherein the portion of the polynucleotide sequence in the comparison window can include additions or deletions (i.e., gaps) as compared to the reference sequence for optimal alignment of the two sequences. In some embodiments, the percentage is calculated by: (a) determining the number of positions at which the identical nucleic acid base occurs in both sequences; (b) dividing the number of matched positions by the total number of positions in the window of comparison; and (c) multiplying the result by 100. Optimal alignment of sequences for comparison can also be conducted by computerized implementations of known algorithms, or by visual inspection. Readily available sequence comparison and multiple sequence alignment algorithms are, respectively, the Basic Local Alignment Search Tool (BLAST) and ClustalW/ClustalW2/Clustal Omega programs available on the Internet (e.g., the website of the EMBL-EBI). Other suitable programs include, but are not limited to, GAP, BestFit, Plot Similarity, and FASTA, which are part of the Accelrys GCG Package available from Accelrys, Inc. of San Diego, California, United States of America. See also Smith & Waterman, 1981; Needleman & Wunsch, 1970; Pearson & Lipman, 1988; Ausubel et al., 1988; and Sambrook & Russell, 2001.

One example of an algorithm that is suitable for determining percent sequence identity and sequence similarity is the BLAST algorithm, which is described in Altschul et al., 1990. In some embodiments, a percentage of sequence identity refers to sequence identity over the full length of one of the gDNA, cDNA, or the predicted protein sequences in the largest ORF of SEQ ID No: 33 being compared (e.g., the full length of any of SEQ ID NOs. 1-47 respectively). In some embodiments, a calculation to determine a percentage of nucleic acid sequence identity does not include in the calculation any nucleotide positions in which either of the compared nucleic acids includes an "N" (i.e., where any nucleotide could be present at that position).

The term "open reading frame" (ORF) refers to a nucleic acid sequence that encodes a polypeptide. In some embodiments, an ORF comprises a translation initiation codon, a translation termination (i.e., stop) codon, and the nucleic acid sequence there between that encodes the amino acids present in the polypeptide. The terms "initiation codon" and "termination codon" refer to a unit of three adjacent nucleotides ('codon') in a coding sequence that specifies initiation and chain termination, respectively, of protein synthesis (mRNA translation).

As used herein, the terms "phenotype," "phenotypic trait" or "trait" refer to one or more traits of a plant or plant cell. The phenotype can be observable to the naked eye, or by any other means of evaluation known in the art, e.g., microscopy, biochemical analysis, or an electromechanical assay. In some cases, a phenotype is directly controlled by a single gene or genetic locus (i.e., corresponds to a "single gene trait"). In the case of haploid induction use of color markers, such as R Navajo, and other markers including transgenes visualized by the presences or absences of color within the seed evidence if the seed is an induced haploid seed. The use of R Navajo as a color marker and the use of transgenes is well known in the art as means to detect induction of haploid seed on the female plant. In other cases, a phenotype is the result of interactions among several genes, which in some embodiments also results from an interaction of the plant and/or plant cell with its environment.

As used herein, the term "plant" can refer to a whole plant, any part thereof, or a cell or tissue culture derived from a plant. Thus, the term "plant" can refer to any of: whole plants, plant components or organs (e.g., leaves, stems, roots, etc.), plant tissues, seeds and/or plant cells.

A plant cell is a cell of a plant, taken from a plant, or derived through culture from a cell taken from a plant. Thus, the term "plant cell" includes without limitation cells within seeds, suspension cultures, embryos, meristematic regions, callus tissue, leaves, shoots, gametophytes, sporophytes, pollen, and microspores. The phrase "plant part" refers to a part of a plant, including single cells and cell tissues such as plant cells that are intact in plants, cell clumps, and tissue cultures from which plants can be regenerated. Examples of plant parts include, but are not limited to, single cells and tissues from pollen, ovules, leaves, embryos, roots, root tips, anthers, flowers, fruits, stems, shoots, and seeds; as well as scions, rootstocks, protoplasts, calli, and the like.

As used herein, the term "primer" refers to an oligonucleotide which is capable of annealing to a nucleic acid target (in some embodiments, annealing specifically to a nucleic acid target) allowing a DNA polymerase and/or reverse transcriptase to attach thereto, thereby serving as a point of initiation of DNA synthesis when placed under conditions in which synthesis of a primer extension product is induced (e.g., in the presence of nucleotides and an agent for polymerization such as DNA polymerase and at a suitable temperature and pH). In some embodiments, one or more pluralities of primers are employed to amplify plant nucleic acids (e.g., using the polymerase chain reaction; PCR).

As used herein, the term "probe" refers to a nucleic acid (e.g., a single stranded nucleic acid or a strand of a double stranded or higher order nucleic acid, or a subsequence thereof) that can form a hydrogen-bonded duplex with a complementary sequence in a target nucleic acid sequence. Typically, a probe is of sufficient length to form a stable and sequence-specific duplex molecule with its complement, and as such can be employed in some embodiments to detect a sequence of interest present in a plurality of nucleic acids.

As used herein, the terms "progeny" and "progeny plant" refer to a plant generated from a vegetative or sexual reproduction from one or more parent plants. In haploid induction the seed on the female parent is haploid, thus not a progeny of the inducing haploid line. The progeny of the haploid seed is what is the desired progeny. There is also the HI seed and subsequent plant and seed progeny of the haploid inducing plant. Both the haploid seed and the HI seed can be progeny. A progeny plant can be obtained by cloning or selfing a single parent plant, or by crossing two or more parental plants. For instance, a progeny plant can be obtained by cloning or selfing of a parent plant or by crossing two parental plants and include selfings as well as the $F_1$ or $F_2$ or still further generations. An $F_1$ is a first-generation progeny produced from parents at least one of which is used for the first time as donor of a trait, while progeny of second generation ($F_2$) or subsequent generations ($F_3$, $F_4$, and the like) are specimens produced from selfings, intercrosses, backcrosses, and/or other crosses of $F_{1S}$, $F_{2S}$, and the like. An $F_1$ can thus be (and in some embodiments is) a hybrid resulting from a cross between two true breeding parents (i.e., parents that are true-breeding are each homozygous for a trait of interest or an allele thereof), while an $F_2$ can be (and in some embodiments is) a progeny resulting from self-pollination of the $F_1$ hybrids.

As used herein, the phrase "recombination" refers to an exchange of DNA fragments between two DNA molecules or chromatids of paired chromosomes (a "crossover") over in a region of similar or identical nucleotide sequences. A "recombination event" is herein understood to refer in some embodiments to a meiotic crossover.

As used herein, the term "reference sequence" refers to a defined nucleotide sequence used as a basis for nucleotide sequence comparison. In some embodiments, any of SEQ ID NOs: 1 and 3 can serve as a reference sequence for comparing to other sequences obtained from plants.

As used herein, the term "regenerate", and grammatical variants thereof, refers to the production of a plant from tissue culture.

As used herein, the phrase "stringent hybridization conditions" refers to conditions under which a polynucleotide hybridizes to its target subsequence, typically in a complex mixture of nucleic acids, but to essentially no other sequences. Stringent conditions are sequence-dependent and can be different under different circumstances.

Longer sequences typically hybridize specifically at higher temperatures. An extensive guide to the hybridization of nucleic acids is found in Sambrook & Russell, 2001. Generally, stringent conditions are selected to be about 5-10° C. lower than the thermal melting point (Tm) for the specific sequence at a defined ionic strength pH. The Tm is the temperature (under defined ionic strength, pH, and nucleic acid concentration) at which 50% of the probes complementary to the target hybridize to the target sequence at equilibrium (as the target sequences are present in excess, at Tm, 50% of the probes are occupied at equilibrium). Exemplary stringent conditions are those in which the salt concentration is less than about 1.0 M sodium ion, typically about 0.01 to 1.0 M sodium ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides).

Stringent conditions can also be achieved with the addition of destabilizing agents such as formamide. Additional exemplary stringent hybridization conditions include 50% formamide, 5×SSC, and 1% SDS incubating at 42° C.; or SSC, 1% SDS, incubating at 65° C.; with one or more washes in 0.2×SSC and 0.1% SDS at 65° C. For PCR, a temperature of about 36° C. is typical for low stringency amplification, although annealing temperatures can vary between about 32° C. and 48° C. (or higher) depending on primer length. Additional guidelines for determining hybridization parameters are provided in numerous references (see e.g., Ausubel et al., 1999).

As used herein, the term "trait" refers to a phenotype of interest, a gene that contributes to a phenotype of interest, as well as a nucleic acid sequence associated with a gene that contributes to a phenotype of interest. For example, a "HI trait" refers to a haploid induction phenotype as well as a gene that contributes to a haploid induction and a nucleic acid sequence (e.g., a HI-associated gene product) that is associated with the presence or absence of the haploid induction phenotype.

As used herein, the term "transgene" refers to a nucleic acid molecule introduced into an organism or one or more of its ancestors by some form of artificial transfer technique. The artificial transfer technique thus creates a "transgenic organism" or a "transgenic cell". It is understood that the artificial transfer technique can occur in an ancestor organism (or a cell therein and/or that can develop into the ancestor organism) and yet any progeny individual that has the artificially transferred nucleic acid molecule or a fragment thereof is still considered transgenic even if one or more natural and/or assisted breedings result in the artificially transferred nucleic acid molecule being present in the progeny individual.

Maize haploid inducer plants produce pollen which when crossed onto non-inducer germplasm results in the gynogenic development of haploid seeds. Unfortunately, this process often yields a low frequency of haploid kernels. Inefficient haploid induction frequency is a limiting factor in maize doubled haploid breeding programs. The present invention identifies a locus that identifies haploid induction in a plant; and a four nucleotide insertion at positions 1230-1233 of SEQ ID NO: 53 the presence or absence of which distinguishes haploid inducer germplasm from non-inducer germplasm. This locus or the presence or absence of the four nucleotide insertion at positions 1230-1233 of SEQ ID NO: 53 can be employed for selecting, and/or introgressing, and/or transforming the haploid inducing trait into plants.

More specifically, the present invention produces new maize haploid-inducing lines. A number of known haploid—inducing maize lines exist including but not limited to: stock 6, MHI (Moldovian Haploid Inducer), indeterminate gametophyte (ig) mutation, KEMS, ZEM, ZMS, KMS, RWS and RWK. —The present invention relates to a method of identifying, and/or selecting germplasm which can or cannot induce haploids. The present invention also relates to increasing and further development of the selected haploid inducing germplasm. The invention further relates to a method of improving haploid inducing germplasm to increase the induction of haploids on the seed producing parent.

The initial step in the production of haploid seeds from a hybrid or segregating maternal parent plant derives from the pollination with pollen from a haploid inducer on to the ear from a seed producing plant. A result of this hybridization process is the production of diploid and maternal haploid (1n) kernels. The induced haploid (1n) kernels are often distinguished from the diploid seed by the use of color markers which indicate embryo ploidy. The diploid seeds are generally discarded, while haploid kernels or embryos are often subjected to chromosome doubling processes to produce doubled haploid plants.

More specifically, the haploid genetic material is treated with one or more mitotic arrest agents to allow the haploid (1n) chromosome complement in one or more cells to produce homolog pairs. After the chemical treatment procedure, the chromosome doubling chemical(s) are removed. The now-doubled haploid maize is allowed to mature and the resulting doubled haploid seeds when planted will produce homozygous plants (also called inbred plant or lines). These inbred lines are the materials that breeders utilize to pursue their hybrid development programs.

The locus for the haploid induction trait was fine mapped. Although a major QTL on chromosome 1 responsible for haploid induction has been mapped and published, Dong et al. Theor. Appl. Genet (2013) 126: 1713-1720, the exact gene/genetic element responsible for the induction process has not been identified until now. The haploid induction locus is fine-mapped to be within a small region of 0.60 Mb (between the markers SM2363 (Chromosome 1, 67851018 nt Maize genome assembly version 3) and SM2712 (Chromosome 1, 68453157 nt Maize genome assembly version 3)). By comparing inducer and non-inducer germplasm, it was determined that a four nucleotide insertion present in haploid inducers which shifts the frame for amino acid coding of GRMZM2G471240 is not present in non-inducer germplasm. Therefore, the present invention has identified a gene with a frameshift mutation in inducer germplasm as being responsible for maize haploid induction. The candidate gene corresponding to gene model GRMZM2G471240 encodes a patatin-like phospholipase 2A.

Also notable are several secondary candidate genes identified as GRMZM2G305400, GRMZM2G082836, GRMZM2G382717, GRMZM2G120587, GRMZM2G062320, and GRMZM2G866758 that also may show differences between inducer and non-inducer lines. The secondary candidate genes may themselves be responsible for improved efficiency in Crossing different HI inducers with these secondary candidate genes such as Stock 6 and RWK lines (each of which lack the candidate gene) can unexpectedly increase haploid induction, which may imply other genetic factors are also contributing to the HI trait. However, improved haploid induction germplasm can be difficult to maintain because it also results in significant seed abortion upon self-pollination and thus, makes HI line maintenance difficult.

DNA sequence was generated for each candidate gene from the two inducer lines and one non-inducer line. In addition, the public B73 genome data was used as a second non-inducer line. Gene model information was compared to EST/cDNA data to confirm the structure of each gene. The annotated sequence data were compared to catalog differences between the four alleles of each gene. The notable exceptions included GRMZM2G305400 which is only identified in the B73 genome and GRMZM2G062320 which is only detected in this study in the NIL and B73 genomes. PCR experiments show that it is present in RWK and Stock 6.

The sequence comparisons revealed that B73 and NIL alleles were similar to each other, and RWK and Stock 6 alleles were similar to each other. Most sequence differences were single nucleotide polymorphisms that do not alter protein coding sequence. There were some insertions and some deletions, most of which are in non-protein coding sequence.

The exceptional sequence difference identified by the method used to generate the sequence data is in GRMZM2G471240, which contains a four nucleotide insertion in RWK and. Stock 6. GRMZM2G471240 (annotated as a patatin-like phospholipase 2A protein) has a frame-shift mutation in the RWK and Stock6 lines resulting from a four base pair insertion in the fourth (and last) exon. When the nucleotide sequence is translated, the mutation shifts the coding frame by one base pair, changing the amino acid (AA) identity for each codon after the mutation. This results in 20 incorrect AA followed by a new, premature stop codon. The entire protein lesion thus constitutes a 30 AA truncation of the protein from the C-terminus, in addition to 20 AA of incorrect sequence between the mutation and the premature stop codon.

The presently disclosed subject matter provides the isolated nucleic acids, the genomic sequence and the protein sequence, the presence or absence, showed an association with HI, as well as any subsequences and informative fragments therefrom. In some embodiments, The presently disclosed subject matter provides isolated cDNA selected from the group consisting of: (a) a nucleic acid having at least 90% identity to SEQ ID NO: 33, SEQ ID NO: 37, SEQ ID NO: 52 or SEQ ID NO: 53, optionally wherein the percent identity is calculated over the entire length of SEQ ID NO: 33, SEQ ID NO: 37, SEQ ID NO: 52 or SEQ ID NO: 53; (b) a nucleic acid having at least 95% identity over nucleotides 91-1452 of SEQ ID NO: 33; (c) a nucleic acid that is the reverse complement of either of (a) or (b); and (d) a nucleic acid that encodes a polypeptide comprising an amino acid sequence that is at least 95% identical to SEQ ID NO: 54, or SEQ ID NO: 55, or SEQ ID NO: 56, or SEQ ID NO: 57 optionally wherein the percent identity is calculated over the entire length of SEQ ID NO: 54, or SEQ ID NO: 55, or SEQ ID NO: 56, or SEQ ID NO: 57.

Comparisons of an amino acid sequence encoded thereby (i.e., SEQ ID NO: 54, SEQ ID NO: 55, SEQ ID NO: 56 and SEQ ID NO: 57) to sequences present in the GENBANK® biosequence database indicated the following this was a patatin-like phospholipase 2A protein. The table below lists gene identities in the interval shown in the tables below. This information is from chromosome 1, and lists a short description of the other encoded proteins from the genes within the haploid inducing locus.

Table Showing Information on Chromosome 1

| gene_id | transcript_start | transcript_end | Query length | Subject length | Score | Identity | Similarity | Align length | Short_description |
|---|---|---|---|---|---|---|---|---|---|
| GRMZM2G305400 | 67991172 | 67994092 | 308 | 362 | 385 | 33.3 | 53.33752 | 314 | Cyclin D2;1 |
| GRMZM2G082836 | 68107606 | 68110989 | 202 | 205 | 729 | 71.2 | 83.33333 | 198 | GTP-binding protein 1 |
| GRMZM2G382717 | 68113455 | 68115168 | 396 | 464 | 489 | 38.77 | 53.17371 | 314 | Chaperone Dna.1-domain superfamily protein |
| GRMZM2G120587 | 68133178 | 68136953 | 458 | 461 | 1329 | 55 | 71.23894 | 452 | serine carboxypeptidase-like 51 |
| GRMZM2G471240 | 68240862 | 68242656 | 428 | 407 | 1049 | 51.5 | 72.36181 | 398 | phospholipase A 2A |
| GRMZM2G471240 | 68240862 | 68242656 | 401 | 407 | 961 | 50.15 | 70.0938 | 395 | phospholipase A 2A |
| GRMZM2G062320 | 68318898 | 68321409 | 335 | 334 | 1064 | 73.3 | 84.21053 | 285 | Phosphoglycerate mutase family protein |
| GRMZM5G866758 | 68430654 | 68436197 | 401 | 403 | 1678 | 80.4 | 90.45226 | 398 | acetoacetyl-CoA thiolase 2 |
| GRMZM5G866758 | 68430654 | 68436197 | 303 | 403 | 1248 | 78.4 | 89.40397 | 302 | acetoacetyl-CoA thiolase 2 |
| GRMZM2G003530 | 68435670 | 68439997 | 360 | 344 | 1063 | 60.5 | 76.41791 | 335 | P-loop containing nucleoside triphosphate hydrolases superfamily protein |
| GRMZM2G077991 | 68543246 | 68546264 | 94 | 95 | 424 | 79.7 | 91.48936 | 94 | Zinc-binding ribosomal protein family protein |
| GRMZM2G077991 | 68543694 | 68546264 | 94 | 95 | 424 | 79.7 | 91.48936 | 94 | Zinc-binding ribosomal protein family protein |
| GRMZM2G077991 | 68543805 | 68546269 | 147 | 95 | 419 | 79.5 | 91.39785 | 93 | Zinc-binding ribosomal protein family protein |
| GRMZM2G077960 | 68554980 | 68559182 | 438 | 478 | 1422 | 65.3 | 79.80998 | 421 | Protein phosphatase 2C family protein |
| GRMZM2G077897 | 68561209 | 68565155 | 784 | 807 | 1561 | 48.1 | 65.69848 | 723 | Plant protein of unknown function (DUF827) |
| GRMZM2G347583 | 68660278 | 68665995 | 1651 | 2156 | 1201 | 41.37 | 55.70954 | 1375 | |
| GRMZM2G173030 | 68668900 | 68671460 | 626 | 2156 | 858 | 35.6 | 48.30299 | 586 | |
| GRMZM2G022061 | 68876150 | 68882226 | 203 | 556 | 618 | 64.9 | 79.89691 | 194 | |
| GRMZM2G022061 | 68876150 | 68882226 | 322 | 556 | 1004 | 66 | 77.47748 | 333 | |
| GRMZM2G022061 | 68876150 | 68882226 | 142 | 556 | 547 | 79.6 | 89.84375 | 128 | |
| GRMZM2G022061 | 68876150 | 68882226 | 322 | 556 | 1004 | 66 | 77.47748 | 333 | |
| GRMZM2G022061 | 68876150 | 68882226 | 534 | 556 | 1802 | 67.7 | 79.81651 | 545 | |
| GRMZM2G340286 | 68928213 | 68929600 | 378 | 403 | 570 | 37.83 | 55.75713 | 407 | |

-continued

| gene_id | transcript_ start | transcript_ end | Query length | Subject length | Score | Identity | Similarity | Align length | Short_description |
|---|---|---|---|---|---|---|---|---|---|
| GRMZM2G340279 | 68934652 | 68937080 | 746 | 937 | 3095 | 29.34 | 50.31745 | 2517 | Tetratricopeptide repeat (TPR)-like superfamily protein |
| GRMZM2G347808 | 69005208 | 69012612 | 589 | 455 | 1115 | 50.4 | 66.60178 | 423 | S-adenosyl-L-methionine-dependent methyltransferases superfamily protein |

RNA interference (RNAi) occurs when an organism recognizes double-stranded RNA (dsRNA) molecules and hydrolyzes them. The resulting hydrolysis products are small RNA fragments of about 19-24 nucleotides in length, called small interfering RNAs (siRNAs). The siRNAs then diffuse or are carried throughout the organism, including across cellular membranes, where they hybridize to mRNAs (or other RNAs) and cause hydrolysis of the RNA. Interfering RNAs are recognized by the RNA interference silencing complex (RISC) into which an effector strand (or "guide strand") of the RNA is loaded. This guide strand acts as a template for the recognition and destruction of the duplex sequences. This process is repeated each time the siRNA hybridizes to its complementary-RNA target, effectively preventing those mRNAs from being translated, and thus "silencing" the expression of specific genes from which the mRNAs were transcribed. Most plant miRNAs show extensive base pairing to, and guide cleavage of their target mRNAs (Jones-Rhoades et al. (2006) Annu. Rev. Plant Biol, 57, 19-53 Llave et al. (2002) Proc. Natl. Acad. Sci. USA 97, 13401-13406). In other instances, interfering RNAs may bind to target RNA molecules having imperfect complementarity, causing translational repression without mRNA degradation. The majority of the animal miRNAs studied so far appear to function in this manner.

Conveniently, the dsRNA can be produced from a single open reading frame in a recombinant host cell, wherein the sense and anti-sense sequences are flanked by an unrelated sequence which enables the sense and anti-sense sequences to hybridize to form the dsRNA molecule with the unrelated sequence forming a loop structure. Alternatively, the sense strand and antisense strand can be made without an open reading frame to ensure that no protein will be made in the transgenic host cell. The two strands can also be expressed separately as two transcripts, one encoding the sense strand and one encoding the antisense strand.

RNA duplex formation can be initiated either inside or outside the cell. The dsRNA can be partially or fully double-stranded. The RNA can be enzymatically or chemically synthesized, either in vitro or in vivo.

The dsRNA need not be full length relative to either the primary transcription product or fully processed RNA. Generally, higher identity can be used to compensate for the use of a shorter sequence. Furthermore, the dsRNA can comprise single stranded regions as well, e.g., the dsRNA can be partially or fully double stranded. The double stranded region of the dsRNA can have a length of at least about 18 to about 25 base pairs, optionally a sequence of about 18 to about 50 base pairs, optionally a sequence of about 50 to about 100 base pairs, optionally a sequence of about 100 to about 200 base pairs, optionally a sequence of about 200 to about 500, and optionally a sequence of about 500 to about 1000 or more base pairs, up to molecule that is double stranded for its full length, corresponding in size to a full length target RNA molecule.

The dsRNA can contain known nucleotide analogs or modified backbone residues or linkages, which are synthetic, naturally occurring, and non-naturally occurring. Examples of such analogs include, without limitation, phosphorothioates, phosphoramidates, methyl phosphonates, chiralmethyl phosphonates and 2-O-methyl ribonucleotides.

As used herein, the term "specifically reduce the level of a target RNA and/or the production of a target protein encoded by the RNA", and variations thereof, refers to the sequence of a portion of one strand of the dsRNA being sufficiently identical to the target RNA such that the presence of the dsRNA in a cell reduces the steady state level and/or the production of said RNA. In many instances, the target RNA will be mRNA, and the presence of the dsRNA in a cell producing the mRNA will result in a reduction in the production of said protein. Preferably, this accumulation or production is reduced at least 10%, more preferably at least 50%, even more preferably at least 75%, yet even more preferably at least 95% and most preferably 100%, when compared to a wild-type cell.

The consequences of inhibition can be confirmed by examination of the outward properties of the cell or organism or by biochemical techniques such as, but not limited to, Northern hybridization, reverse transcription, gene expression monitoring with a microarray, antibody binding, enzyme linked immunosorbent assay (ELISA), Western blotting, radioimmunoassay (RIA))), and other immunoassays.

MicroRNAs (miRNAs) are non-protein coding RNAs, generally of between about 18 to about 25 nucleotides in length (commonly about 20-24 nucleotides in length in plants). These miRNAs direct cleavage in trans of target transcripts, negatively regulating the expression of genes involved in various regulation and development pathways (Bartel, Cell, 116:281-297 (2004); Zhang et al. Dev. Biol. 289:3-16 (2006)). As such, miRNAs have been shown to be involved in different aspects of plant growth and development as well as in signal transduction and protein degradation. In addition, small endogenous mRNAs including miRNAs may also be involved in biotic stress responses such as pathogen attack. Since the first miRNAs were discovered in plants (Reinhart et al. Genes Dev. 16:1616-1626 (2002), Park et al. Curr. Biol. 12:1484-1495 (2002)) many hundreds have been identified. Furthermore, many plant miRNAs have been shown to be highly conserved across very divergent taxa. (Floyd et al. Nature 428:485-486 (2004); Zhang et al. Plant J. 46:243-259 (2006)). Many microRNA genes (MI R genes) have been identified and made publicly available in a data base (miRBase; microma.sanger.ac.uk/sequences). miRNAs are also described in U.S. Patent Publications 2005/0120415 and 2005/144669A1, the entire contents of which are incorporated by reference herein.

Genes encoding miRNAs yield primary miRNAs (termed a "pri-miRNA") of 70 to 300 bp in length that can form imperfect stem-loop structures. A single pri-miRNA may contain from one to several miRNA precursors. In animals, pri-miRNAs are processed in the nucleus into shorter hairpin RNAs of about 65 nt (pre-miRNAs) by the RNaseIII enzyme Drosha and its cofactor DGCR8/Pasha. The pre-miRNA is then exported to the cytoplasm, where it is further processed by another RNaseIII enzyme, Dicer, releasing a miRNA/miRNA* duplex of about 22 nt in size. In contrast to animals, in plants, the processing of pri-miRNAs into mature miRNAs occurs entirely in the nucleus using a single RNaseIII enzyme, DCLI (Dicer-like 1). (Zhu. Proc. Natl. Acad. Sci. 105:9851-9852 (2008)). Many reviews on microRNA biogenesis and function are available, for example, see, Bartel Cell 116:281-297 (2004), Murchison et al, Curr. Opin, Cell Biol. 16:223-229 (2004), Dugas et al. Curr. Opin. Plant Biol. 7:512-520 (2004) and. Kim Nature Rev. Mol. Cell Biol. 6:376-385 (2005).

The term "plant microRNA precursor molecule" as used herein describes a small (~70-300 nt) non-coding RNA sequence that is processed by plant enzymes to yield a ~19-24 nucleotide product known as a mature microRNA sequence. The mature sequences have regulatory roles through complementarity to messenger RNA. The term "artificial plant microRNA precursor molecule" describes the non-coding miRNA precursor sequence prior to processing that is employed as a backbone sequence for the delivery of a siRNA molecule via substitution of the endogenous native miRNA/miRNA* duplex of the miRNA precursor molecule with that or a non-native, heterologous miRNA (amiRNA/amiRNA*; e.g. siRNA/siRNA*) that is then processed into the mature miRNA. sequence with the siRNA sequence.

A "coding sequence" is a nucleic acid sequence that is transcribed into RNA such as mRNA, rRNA, tRNA, snRNA, sense RNA or antisense RNA. Preferably the RNA is then translated in an organism to produce a protein.

As used herein, "complementary" polynucleotides are those that are capable of base pairing according to the standard Watson-Crick complementarity rules. Specifically, purines will base pair with pyrimidines to form a combination of guanine paired with cytosine (G:C) and adenine paired with either thymine (A:T) in the case of DNA, or adenine paired with uracil (A:U) in the case of RNA. For example, the sequence "A-G-T" binds to the complementary sequence "T-C-A." It is understood that two polynucleotides may hybridize to each other even if they are not completely complementary to each other, provided that each has at least one region that is substantially complementary to the other.

The terms "complementary" or "complementarity," as used herein, refer to the natural binding of polynucleotides under permissive salt and temperature conditions by base-pairing. Complementarity between two single-stranded molecules may be "partial," in which only some of the nucleotides bind, or it may be complete when total complementarily exists between the single stranded molecules. The degree of complementarity between nucleic acid strands has significant effects on the efficiency and strength of hybridization between nucleic acid strands.

As used herein, the terms "substantially complementary" or "partially complementary" mean that two nucleic acid sequences are complementary at least a bout 50%, 60%, 70%, 80% or 90% of their nucleotides. In some embodiments, the two nucleic acid sequences can be complementary at least at 85%, 90%, 95%, 96%, 97%, 98%, 99% or more of their nucleotides. The terms "substantially complementary" and "partially complementary" can also mean that two nucleic acid sequences can hybridize under high stringency conditions and such conditions are well known in the art In some embodiments, the dsRNA molecule can comprise, consist essentially of or consist of from at least 18 to a bout 25 consecutive nucleotides (e.g. 18, 19, 20, 21, 22, 23, 24 or 25) to at least about 400 consecutive nucleotides. In some embodiments the dsRNA molecule can comprise, consist essentially of or consist of about 500, or about 50 or about 543 consecutive nucleotides, Additional nucleotides can be added at the 3' end, the 5' end or both the 3' and 5' ends to facilitate manipulation of the dsRNA molecule but that do not materially affect the basic characteristics or function of the dsRNA molecule in RNA interference (RNAi).

In some embodiments, the portion of the mRNA polynucleotide transcribable from a GRMZM2G471240 gene that the antisense strand is complementary to comprises at least 18 consecutive nucleotides of SEQ ID NO:33, SEQ ID NO:37, SEQ ID NO:52 or SEQ ID NO:53. In other embodiments, the portion of mRNA comprises, consists essentially of or consists of at least from 19, 20 or 21 consecutive nucleotides to at least 400 consecutive nucleotides of SEQ ID NO:33, SEQ ID NO:37, SEQ ID NO:52 or SEQ ID NO:53. In other embodiments, the portion of mRNA comprises, consists essentially of or consists of at least about 500, or at least about 98 or at least about 185 consecutive nucleotides of SEQ ID NO:33.

In other embodiments, the portion of the mRNA polynucleotide that is complementary to the antisense strand of a dsRNA of the invention comprises any 19-mer subsequence of SEQ ID NO:33 (GRMZM2G47:1240) consisting of N to N+18 nucleotides, wherein N is nucleotide 1 to 1452 of SEQ ID NO:33. In other words, the portion of the mRNA that is targeted comprises any of the 1452 19 consecutive nucleotide subsequences (i.e. 19-mer) of SEQ ID NO:33, for example, bases 1-19 (5'-AGTTCATCACTAATCACAC-3'), bases 2-20 (5'-GTTCATCACTAATCACACT-3'), bases 3-21 (5'-TTCATCACTAATCACACTT-3') and so forth to bases 1434-1452 (5'-AAAACATAAAAATATATAT-3').

In other embodiments, the nucleotide sequence of the antisense strand can consist essentially of the nucleotide sequence of any 19-mer subsequence of SEQ ID NO:62 consisting of N to N+18 nucleotides, wherein N is nucleotide 1 to nucleotide 1452 of SEQ ID NO:62. In other words, the antisense strand consists essentially of the nucleotide sequence of any of the 1452 19 consecutive nucleotide subsequences (i.e. 19-mer) of SEQ ID NO:62, for example, bases 1-19 (5'-ATATATATTTTTATGTTTT-3'), bases 2-20 (5'-TATATATTTTTATGTTTTA-3'), bases 3-21 (5'-ATATATTTTTATGTTTTAT-3') and so forth to bases 1434-1452 (5'-GTGTGATTAGTGATGAACT-3').

It would be understood that the deletion of the one nucleotide or the addition of up to six nucleotides do not materially affect the basic characteristics or function of the double stranded. RNA molecule of the invention. Such additional nucleotides can be nucleotides that extend the complementarity of the antisense strand along the target sequence and/or such nucleotides can be nucleotides that facilitate manipulation of the RNA molecule or a nucleic acid molecule encoding the RNA molecule, as would be known to one of ordinary skill in the art. For example, a IT overhang at the 3; end may be present, which is used to stabilize the siRNA duplex and does not affect the specificity of the siRNA.

In some embodiments of this invention, the antisense strand of the double stranded RNA molecule can be fully complementary to the target RNA polynucleotide or the antisense strand can be substantially complementary or partially complementary to the target RNA polynucleotide. By substantially or partially complementary is meant that the antisense strand and the target RNA polynucleotide can be mismatched at about 1, 2, 3, 4, 5, 6, 7, 8, 9, or 10 nucleotide pairings. Such mismatches can be introduced into the antisense strand sequence, e.g., near the 3' end, to enhance processing of the double stranded RNA molecule by Dicer, to duplicate a pattern of mismatches in a siRNA molecule inserted into a chimeric nucleic acid molecule or artificial microRNA precursor molecule of this invention, and the like, as would be known to one of skill in the art. Such modification will weaken the base pairing at one end of the duplex and generate strand asymmetry, therefore enhancing the chance of the antisense strand, instead of the sense strand, being processed and silencing the intended gene (Gong and Ding "Double-mismatched siRNAs enhance selective gene silencing of a mutant ALS-causing Allelel" Acta Pharmacol. Sin. 29:211-216 (2008); Schwarz et al. "Asymmetry in the assembly of the RNAi enzyme complex" Cell 115:199-208 (2003)). Other such mismatches can be introduced into the antisense strand due to eliminating fortuitous open reading frames created in making dsRNA encoding expression cassettes. Such open reading frames are eliminated by making point mutations in the dsRNA encoding nucleotide sequence thus creating some mismatches in the dsRNA compared to the target gene. In some embodiments of this invention, the dsRNA molecule of the invention is a short hairpin RNA (shRNA) molecule. Expression of shRNA in cells is typically accomplished by delivery of plasmids or recombinant vectors, for example in transgenic plants such as transgenic corn.

The invention encompasses a nucleic acid molecule encoding at least one strand of a dsRNA molecule of the invention. The invention further encompasses a nucleic acid construct comprising at least one strand of a dsRNA molecule of the invention or comprising the nucleic acid molecule encoding the at least one strand of a dsRNA molecule of the invention. In one embodiment of the invention, the nucleic acid molecule encodes a short hairpin RNA. In another embodiment, the nucleic acid molecule that encodes the short hairpin RNA comprises SEQ ID NO:62 or SEQ ID NO:63

The invention further encompasses chimeric nucleic acid molecules comprising an antisense strand of a dsRNA of the invention operably linked with a plant microRNA precursor molecule. In some embodiments, the chimeric nucleic acid molecule comprises an antisense strand having the nucleotide sequence of any of the 19-mer subsequences of SEQ ID NO:33, SEQ ID NO:37, SEQ ID NO:52 or SEQ ID NO:53 operably linked with a plant microRNA precursor molecule. In some embodiments, the plant microRNA precursor molecule is a maize microRNA precursor.

In some embodiments, the invention encompasses an artificial plant microRNA precursor molecule comprising an antisense strand of a dsRNA molecule of the invention. In other embodiments, the artificial plant microRNA precursor molecule comprises an antisense strand having the nucleotide sequence of any of the 19-mer subsequences of SEQ ID NO:62, or SEQ ID NO:63. The use of artificial plant microRNAs to deliver a nucleotide sequence of interest (e.g. an artificial miRNA; siRNA/siRNA*) into a plant is known in the art (see, e.g., Schwab et al. 2006. The Plant Cell 18:1121-1133 and Examples section herein). In the invention, the artificial microRNAs are chimeric or hybrid molecules, having a plant microRNA precursor backbone and an insect (i.e. animal) siRNA sequence inserted therein. As would be understood by one of ordinary skill in the art, it is typically desirable to maintain mismatches that normally occur in the plant microRNA precursor sequence in any nucleotide sequence that is substituted into the plant microRNA precursor backbone. In still other embodiments, the artificial plant microRNA precursor comprises portions of a corn microRNA precursor molecule. Any coni microRNA (miRNA) precursor is suitable for the compositions and methods of the invention. Nonlimiting examples include miR156, miR159, miR160, miR162, miR164, miR166, miR167, miR168, miR169, miR171, miR172, miR319, miR390, miR393, miR394, miR395, miR396, miR397, miR398, miR399, miR408, miR482, miR528, miR529, miR827, miR1432, as well as any other plant miRNA precursors now known or later identified.

In some embodiments, the invention encompasses nucleic acid constructs, nucleic acid molecules or recombinant vectors comprising at least one strand of a dsRNA molecule of the invention, or comprising a chimeric nucleic acid molecule of the invention, or comprising an artificial plant microRNA of the invention. In some embodiments the nucleic acid construct comprises a nucleic acid molecule of the invention. In other embodiments, the nucleic acid construct is a recombinant expression vector.

In some embodiments, the invention encompasses compositions comprising two or more dsRNA molecules of the invention wherein the two or more RNA molecules each comprise a different antisense strand. In some embodiments the two or more dsRNA molecules are present on the same nucleic acid construct, on different nucleic acid constructs or any combination thereof. In other embodiments, the composition comprises an RNA molecule comprising an antisense strand consisting essentially of the nucleotide sequence of SEQ ID NO:62 and an RNA molecule comprising an antisense strand consisting essentially of the nucleotide sequence of SEQ ID NO:63. In other embodiments, the composition comprises two or more nucleic acid constructs, two or more nucleic acid molecules, two or more chimeric nucleic acid molecules, two or more artificial plant microRNA precursors of the invention, wherein the two or more nucleic acid constructs, two or more nucleic acid molecules, two or more chimeric nucleic acid molecules, or two or more artificial plant microRNA precursors, each comprise a different antisense strand.

RNA interference (RNAi) can be used to produce genetically modified plants that are tolerant or resistant to abiotic and biotic stresses, In the past decade, RNAi has been described and characterized in organisms as diverse as plants, fungi, nematodes, hydra, and humans. Zamore and Haley (2005) Science 309, 1519-24. RNA interference in plants is commonly referred to as post-transcriptional gene silencing or RNA silencing and is referred to as quelling in fungi. The process of post-transcriptional gene silencing is thought to be an evolutionarily conserved cellular defense mechanism used to prevent the expression of foreign genes and is commonly shared by diverse flora and phyla. Fire (1999) Trends Genet. 15, 358-363.

RNA interference occurs when an organism recognizes double-stranded RNA molecules and hydrolyzes them. The resulting hydrolysis products are small RNA fragments of 19-24 nucleotides in length, called small interfering RNAs (siRNAs) or microRNAs (miRNAs). The siRNAs then diffuse or are carried throughout the organism, including across cellular membranes, where they hybridize to mRNAs (or other RNAs) and cause hydrolysis of the RNA. Most plant miRNAs show extensive base pairing to, and guide cleavage of their target mRNAs. Jones-Rhoades et al. (2006) Annu. Rev. Plant Biol 57, 19-53; Llave et al. (2002) Proc. Natl. Acad. Sci. USA 97, 13401-10406. In other instances, interfering RNAs may bind to target RNA molecules having imperfect complementarity, causing translational repression without mRNA degradation.

The mode of action for silencing a plant gene generally includes a double stranded RNA (dsRNA) that associates with a dicer enzyme that cuts the dsRNA into ds fragments 19-24 bps in length (siRNA). There may be more than one dicer enzyme, depending on the organism. Meister and Tuschl, 2004). The siRNA is typically degraded into two single stranded RNAs (ssRNAs), referred to as the passenger strand and the guide strand. A RNA-interference silencing complex (RISC complex) loads the guide strand. The RISC complex associates with a target mRNA that has partial or complete homology to the guide strand. The catalytic RISC component agronaute causes cleavage of the target mRNA preventing it from being used as a translation template. Ahlquist P (2002) RNA-dependent RNA polymerases, viruses, and RNA silencing, Science 296 (5571): 1270-3. The RNAi pathway is exploited in plants by using recombinant technology, which entails transforming a plant with a vector comprising DNA that when expressed produces a dsRNA homologous or nearly homologous to a gene target. The gene target can be homologous to a endogenous plant gene or an insect gene. If the target is an insect gene, the insect eats the plant thereby ingesting the dsRNA, at which the RNAi RISC complex of the insect causes cleavage and targeting of the homologous mRNA, causing disruption of a vital insect process.

To date, plant recombinant technology is the vehicle for delivering gene silencing of target genes, either endogenous plant target genes or target genes of a plant pest organism. In general, a plant is transformed with DNA that is incorporated into the plant genome, and when expressed produces a dsRNA that is complementary to a gene of interest, which can be an endogenous plant gene or an essential gene of a plant pest. Plant recombination techniques to generate transgene and beneficial plant traits require significant investments in research and development, and pose significant regulatory hurdles. Methods and formulations for delivering dsRNA into plant cells by exogenous application to exterior portions of the plant, such as leaf, stem, and/or root surfaces for regulation of endogenous gene expression are not known in the art. Such methods and formulations represent a significant development for gene silencing technology. Known methods for delivering exogenous dsRNA into plant cells are via particle bombardment or viral RNA infection through wounding the plant tissue (e.g. tobacco and rice leaf tissues). Application by spray or brush of RNA molecules, or other non-tissue evasive techniques, resulting in assimilation of the exogenous RNA molecules into plant tissue, thereby causing endogenous and/or pest gene silencing, has not been reported.

The present invention is directed to methods and formulations to incorporate exogenous RNA, by application to external tissue surface(s) of plants, into the plant cells causing silencing of plant endogenous target gene(s) or of the target genes of plant pests.

The present invention is not directed to any particular RNAi mechanism or mode of action of gene silencing, and should not be construed as limited to any such mechanisms, known or unknown.

The terms "silencing" and "suppression" are used interchangeably to generally describe substantial and measurable reductions of the amount of the target mRNA available in the cell for binding and decoding by ribosomes. The transcribed RNA can be in the sense orientation to effect what is referred to as co-suppression, in the anti-sense orientation to effect what is referred to as anti-sense suppression, or in both orientations producing a double-stranded RNA to effect what is referred to as RNA interference. A "silenced" gene includes within its definition a gene that is subject to silencing or suppression of the mRNA encoded by the gene.

MicroRNAs are encoded by genes that are transcribed but not translated into protein (non-coding DNA), although some miRNAs are encoded by sequences that overlap protein-coding genes. By way of background, miRNAs are processed from primary transcripts known as pri-miRNAs to short stem loop structures called pre-miRNAs that are further processed by action of dicer enzyme(s) creating functional siRNAs/miRNAs. Typically, a portion of the precursor miRNA is cleaved to produce the final miRNA molecule. The stem-loop structures may range from, for example, about 50 to about 80 nucleotides, or about 60 nucleotides to about 70 nucleotides (including the miRNA residues, those pairing to the miRNA, and any intervening segments). The secondary structure of the stem-loop structure is not fully base-paired; mismatches, bulges, internal loops, non-WatsonCrick base pairs (i.e., G-U wobble base pairs), and other features are frequently observed in pre-miRNAs and such characteristics are thought to be important for processing. Mature miRNA molecules are partially complementary to one or more mRNA molecules, and they function to regulate gene expression. siRNAs of the present invention have structural and functional properties of endogenous miRNAs (e.g., gene silencing and suppressive functions). Thus, in various aspects of the invention, siRNAs of the invention can derived from miRNAs, from target gene sequence information, or can be produced synthetically, based on predictive models known in the art. The phrases "target-specific small interfering RNAs," "target-specific siRNAs," "target-specific microRNAs," "target-specific miRNAs," "target-specific amiRNAs," and "target-specific nucleotide sequence" refer to interfering RNAs that have been designed to selectively hybridize with nucleic acids in a target organism, but not in a non-target organism, such as a host organism (the organism expressing or producing the miRNA) or a consumer of the host organism. Consequently, "target-specific siRNAs" only produce phenotypes in target organisms and do not produce phenotypes in non-target organisms. In the present invention, the target-specific siRNAs selectively hybridize to nucleic acids that are endogenous to the host organism, which are plants. MicroRNAs (miRNAs) are non-protein coding RNAs, generally of between about 19 to about 25 nucleotides (commonly about 20-24 nucleotides in plants). miRNAs direct cleavage in trans of target transcripts, regulating the expression of genes involved in various regulation and development pathways (Bartel, Cell, 116:281-297 (2004); Zhang et al. Dev. Biol. 289:3-16 (2006)). miRNAs have been shown to be involved in different aspects of plant growth and development as well as in signal transduction and protein degradation. In addition, growing evidence indicates that small endogenous mRNAs including miRNAs may also be involved in biotic stress responses such as parasite attack. Since the first miRNAs were discovered in plants (Reinhart et al. Genes Dev. 16:1616-1626 (2002), Park et al. Curr. 12:1484-1495 (2002)), many hundreds have been identified. Further, many plant miRNAs have been shown to be highly conserved across very divergent taxa. (Floyd et al. Nature 428:485-486 (2004); Zhang et al. Plant J. 46:243-259 (2006)). Many microRNA genes (MIR genes) have been identified and made publicly available in a database ("miRBase," available on line at microrna.sanger.ac.uk/sequences). miRNAs are also described in U.S. Patent Publications 2005/0120415 and 2005/144669A1, the entire contents of which are incorporated by reference herein.

Further encompassed within the presently disclosed subject matter are expression cassettes according to the embodiments of the presently disclosed subject matter as well as expression vectors (see FIG. 3) comprising the same. Also encompassed are plant cells comprising expression cassettes according to the present disclosure, and plants comprising these plant cells. In some embodiments, the plant is a dicot. In some embodiments, the plant is a monocot. In some embodiments, the monocot is a cereal. The plant can be, for example, rice, maize, grass, wheat, maize, barley, brome, oats, rye, millet, sorghum, triticale, secale, einkorn, spelt, emmer, teff, milo, flax, gramma grass, Tripsacum, or teosinte.

Thus, the compositions of the presently disclosed subject matter can comprise nucleic acid sequences for transformation and expression in a plant of interest. The expression is of the primary candidate gene and HI trait is desired the expression may also be for down regulated expression or induced expression in some or all of the female portion of the plant and no expression in the male flowering plant parts. The nucleic acid sequences can be present in DNA constructs or expression cassettes. "Expression cassette" as used herein means a nucleic acid molecule capable of directing expression of a particular nucleotide sequence, or iRNA in an appropriate host cell, comprising a promoter operatively linked to the sequence of interest (e.g., a sequence encoding a gene product or iRNA associated with HI) which is optionally also operatively linked to termination signals. It also typically comprises sequences required for proper translation of the nucleotide sequence. The coding region usually codes for a protein of interest but can also code for a functional RNA of interest, for example antisense RNA or a nontranslated RNA such as, but not limited to a siRNA, in the sense or antisense direction. The expression cassette comprising the nucleotide sequence of interest can be chimeric, meaning that at least one of its components is heterologous with respect to at least one of its other components. The expression cassette can also be one that is naturally occurring but has been obtained in a recombinant form useful for heterologous expression. In some embodiments, the expression cassette is heterologous with respect to the host (i.e., the particular DNA sequence of the expression cassette, or a subsequence thereof, does not occur naturally in the host cell and must have been introduced into the host cell or an ancestor of the host cell by a transformation event). The expression of the nucleotide sequence in the expression cassette can be under the control of a constitutive promoter, a tissue specific promoter, and/or an inducible promoter that initiates transcription only when the host cell is exposed to some particular external stimulus, a minimal promoter, etc. Additionally, the promoter can also be specific to a particular cell type, tissue, organ, and/or stage of development. In some embodiments, an expression cassette is present in a vector that permits replication of the expression cassette in a host cell.

The present presently disclosed subject matter encompasses the transformation of plants with expression cassettes capable of expressing a polynucleotide of interest (e.g., a polynucleotide encoding a gene product or iRNA associated with HI) alone or in combination with one or more additional nucleic acid molecules encoding polypeptides that confer desirable traits. However, if the polynucleotide is the primary gene, GRMZM2G062320, it maybe preferred that the cassette is adapted to down regulate or knock out the gene in nonhaploid inducing material. Or expressed in an inducible matter so that the pollen used to self the HI plant is expressing the gene product that occurs in B73 and other non haploid inducing material. In some embodiments, the expression cassette includes at least the following basic elements oriented in the 5'-3' direction of transcription: a transcriptional and translational initiation region (i.e., a promoter) and a polynucleotide of interest. The expression cassette can optionally comprise a transcriptional and translational termination region (e.g., termination region) functional in plants. In some embodiments, the expression cassette comprises a selectable marker gene to allow for selection for stable transformants.

In some embodiments, the regulatory sequences of the expression construct are operably linked to the polynucleotide of interest. By "operably linked" is intended a functional linkage between a first sequence (e.g., a promoter) and a second sequence (e.g., a coding sequence), wherein the first sequence influences a biological event (e.g., transcription, transcription, replication, etc.) that occurs with respect to the second sequence. Generally, operably linked means that the nucleotide sequences being linked are contiguous in a single molecule.

Any promoter capable of driving expression in the plant of interest can be used in the practice of the presently disclosed subject matter. In some embodiments, the expression cassette is expressed throughout the plant. In some embodiments, the expression cassette is expressed in a specific location and/or tissue of a plant, or at a certain time during the development of the plant. In some embodiments, the location and/or tissue includes, but is not limited to, anther, ovule, plastid, pollen, mitochondrion, chloroplast, epidermis, root, vascular tissue, meristem, cambium, cortex, pith, leaf, flower, and combinations thereof. In another embodiment, the location and/or tissue is a seed.

The promoter can be native or analogous, or can be heterologous or exogenous, to the plant or plant cell in which it is intended to be active. The terms "heterologous" and "exogenous" when used herein to refer to a nucleic acid sequence (e.g., a DNA or RNA sequence) or a gene, refer to a sequence that originates from a source foreign to the particular host cell or, if from the same source, is modified from its original form. Thus, a heterologous gene in a host cell includes a gene that is endogenous to the particular host cell but has been modified through, for example, the use of DNA shuffling. The terms also include non-naturally occurring multiple copies of a naturally occurring DNA sequence. Thus, in some embodiments the terms refer to a DNA segment that is foreign or heterologous to the cell, or homologous to the cell but in a position within the host cell nucleic acid in which the element is not ordinarily found. In some embodiments, an exogenous DNA segment is expressed to yield an exogenous polypeptide in a cell or tissue type of interest. In some embodiments, a heterologous or exogenous nucleic acid is referred to herein as a transgene.

A "homologous" nucleic acid (e.g., DNA) sequence is a nucleic acid (e.g., DNA or RNA) sequence that is naturally associated with a host cell into which it is introduced. As such, and by way of example and not limitation, a nucleic acid that is derived from (i.e., isolated from with or without subsequent modification) a plant cell or tissue could be considered a homologous nucleic acid when reintroduced into a plant cell or tissue of the same species, but could be considered heterologous or exogenous when introduced into a cell or tissue of a plant other than the plant species from which it was derived. In some embodiments, a homologous nucleic acid can also be referred to herein as a heterologous or a transgene when the homologous nucleic acid is operatively linked to a nucleotide sequence to which it is not naturally operatively linked.

The choice of promoters to be included depends in some embodiments upon several factors, including, but not limited to, efficiency, selectability, inducibility, desired expression level, and/or cell- or tissue-preferential and/or -specific expression. It is a routine matter for one of skill in the art to modulate the expression of a sequence by appropriately selecting and positioning promoters and other regulatory regions relative to that sequence. The promoters that are used for expression of the transgene(s) can be in some embodiments a strong plant promoter, in some embodiments a viral promoter, and in some embodiments a chimeric promoter comprising such basic transcriptional regulatory elements such as but not limited to a TATA box from any gene (or synthetic, based on analysis of plant gene TATA boxes), optionally fused to the region 5' to the TATA box of plant promoters (which direct tissue and temporally appropriate gene expression), optionally fused to one or more enhancers (such as the 35S enhancer, FMV enhancer, CMP enhancer, etc.).

For example, the selection of the promoter used in expression cassettes can determine the spatial and temporal expression pattern of the transgene in the transgenic plant. Selected promoters can express transgenes in specific cell types and/or in specific tissues or organs, and the selection can reflect the desired location for accumulation of the gene product. Alternatively, the selected promoter can drive expression of the gene under various inducing conditions. Promoters vary in their strength; i.e., their abilities to promote transcription. Depending upon the host cell system utilized, any one of a number of suitable promoters can be used, including the gene's native promoter. The following are non-limiting examples of promoters that can be used in expression cassettes.

Promoters which are directing expression of the gene are referred to herein as "constitutive" promoters and are active under most environmental conditions and states of development or cell differentiation. Examples of constitutive promoters include the 1'- or 2'-promoter derived from T-DNA of *Agrobacterium tumefaciens*, and other transcription initiation regions from various plant genes known to those of ordinary skill in the art. Such genes include, but are not limited to, the inducible promoters of AP2 gene; ACT11 from *Arabidopsis* (Huang et al., 1996); Cat3 from *Arabidopsis* (GENBANK® Accession No. U43147; Zhong et al., 1996); the gene encoding stearoyl-acyl carrier protein desaturase from *Brassica napus* (GENBANK® Accession No. X74782; Solocombe et al., 1994); GPc1 from maize (GENBANK® Accession No. X15596; Martinez et al., 1989); and Gpc2 from maize (GENBANK® Accession No. U45855; Manjunath et al., 1997). Additional non-limiting examples of constitutive promoters include, for example, the core promoter of the Rsyn7 promoter and other constitutive promoters disclosed in PCT International Patent Application Publication No. WO 1999/43838 and U.S. Pat. No. 6,072,050; various ubiquitin promoters (see e.g., U.S. Pat. Nos. 5,641,876 and 8,168,859; Christensen et al., 1989; Christensen et al., 1992; Wei et al., 2003; Lu et al., 2008); the core CaMV 35S promoter (Odell et al., 1985; Benfey & Chua, 1990); the CaMV 19S promoter; the figwort mosaic virus (FMV) promoter; the rice actin-1 promoter (McElroy et al., 1990); the rice alpha tubulin (tubA1) promoter (Fiume et al., 2004); pEMU (Last et al., 1991); the Cestrum yellow leaf curling virus (CmYLCV) CMP promoter (Hohn et al., 2007; U.S. Pat. No. 7,166,770); the MAS promoter (Velten et al., 1984); the Super MAS promoter (Ni et al., 1995; Lee et al., 2007); the ALS promoter (U.S. Pat. No. 5,659,026), and the like. Other constitutive promoters include, for example, those disclosed in U.S. Pat. Nos. 5,608,149; 5,608,144; 5,604,121; 5,569,597; 5,466,785; 5,399,680; 5,268,463; 5,608,142; and 6,177,611.

The present invention shows a frame shift mutation in GRMZM2G471240 in the Haploid inducing material, thus RNAi silencing of GRMZM2G471240 will create a HI line. The silencing can be accomplished in numerous ways including expression of a hairpin or artificial mircoRNA to target GRMZM2G471240. The down regulated expression transformants will allow various types of germplasm to act as HI lines.

It should also be possible to compensate the defect in a HI line. Transgenic material with the non haploid inducing sequence when expressed (SEQ ID NO: 33) should if joined with an inducible promoter make the HI line switchable between being a HI line and a non HI line. Therefore, transformation methods, cassettes, vectors and transgenic plant with the non HI sequence are described herein.

Appropriate plant or chimeric promoters are useful for applications such as expression of transgenes and/or other heterologous or homologous nucleic acids in certain tissues, while minimizing expression (including but not limited to a level of expression that is below detection using routine techniques) in other tissues, in some embodiments such as but not limited to seeds and/or female reproductive tissues. In some embodiments, expression of a nucleic acid designed to silence a gene product associated with HI of the current presently disclosed subject matter can optionally be localized to seed, or fruit tissues and preferably no expression in the anther or pollen or very downregulated expression if this gene product is present at all in the anther or pollen. The data suggests that expression of the expression is most likely important in early reproductive structures, particularly female structures. Exemplary cell type- or tissue-preferential (in some embodiments, tissue-specific) promoters drive expression preferentially (or in some embodiments essentially specifically) in the target tissue, but can also lead to some expression in other cell types or tissues as well. Methods for identifying and characterizing promoter regions in plant genomic DNA include, for example, those described in the following references: Green et al., 1988; Bustos et al., 1989; Jordano et al., 1989; Meier et al., 1991; and Zhang et al., 1996.

Alternatively, the plant promoter can direct expression of the nucleic acid molecules of the presently disclosed subject matter in a specific tissue or can be otherwise under more precise environmental or developmental control. Examples of environmental conditions that can effect transcription by inducible promoters include anaerobic conditions, elevated temperature, or the presence of light. Such promoters are referred to herein as "inducible", "cell type-specific", or "tissue-specific" promoters. Those of ordinary skill in the art will recognize that a tissue-specific promoter can drive expression of operatively linked sequences in tissues other than the target tissue. Thus, as used herein a "tissue-specific" promoter is one that drives expression preferentially in the target tissue, but can also lead to some expression in other tissues as well.

Examples of promoters under developmental control include promoters that initiate transcription preferentially or exclusively in certain tissues, such as pollen, anthers, fruit, seeds, or flowers. Promoters that direct expression of nucleic acids in pollen, anthers, and the like and possibly in ovules, flowers, or seeds are particularly useful in the presently disclosed subject matter. As used herein a seed-specific promoters are active in cells destined to produce the ovule and tend to direct expression specifically or preferentially in the seed tissues. And reproduction specific promoters are promoters that are active in cells destined to produce the male parts such as the anther, pollen and microspores and the female parts such as the ovule, silks, embryo, and seed. And male Reproductive specific promoters are promoters that are active in cells destined to produce the male parts like pollen.

Seed specific promoters can be, for example, ovule-specific, embryo-specific, endosperm-specific, integument-specific, seed coat-specific, or some combination thereof. Examples include a promoter from the ovule-specific BEL1 gene described in Reiser et al., 1995 (GENBANK® Accession No. U39944). Non-limiting examples of seed specific promoters are derived from the following genes: MAC1 from maize (Sheridan et al., 1996); Cat3 from maize (GENBANK® Accession No. L05934; Abler et al., 1993); the gene encoding oleosin 18 kD from maize (GENBANK® Accession No. J05212; Lee & Huang, 1994); vivparous-1 from *Arabidopsis* (GENBANK® Accession No. U93215); the gene encoding oleosin from *Arabidopsis* (GENBANK® Accession No. Z17657); Atmycl from *Arabidopsis* (Urao et al., 1996); the 2s seed storage protein gene family from *Arabidopsis* (Conceicao et al., 1994); the gene encoding oleosin 20 kD from *Brassica napus* (GENBANK® Accession No. M63985); napA from *Brassica napus* (GENBANK® Accession No. J02798; Josefsson et al., 1987); the napin gene family from *Brassica napus* (Sjodahl et al., 1995); the gene encoding the 2S storage protein from *Brassica napus* (Dasgupta et al., 1993); the genes encoding oleosin A (GENBANK® Accession No. U09118) and oleosin B (GENBANK® Accession No. U09119) from soybean; and the gene encoding low molecular weight sulfur rich protein from soybean (Choi et al., 1995). Additional cell type- and/or tissue-specific promoters include, but are not limited to the *Triticum aestivum* pistil specific P19 promoter (see Japanese Patent Application JP 2001512988-A/13); the maize silk promoter prB200 (see Japanese Patent Application JP 001512988-A/13), the maize prCDPK-01 and prCDPK-02 promoters (Estruch et al., 1994); the rice α-N-acetylglucosaminidase (prOsANG) promoter (U.S. Pat. No. 7,550,578); the rice MADS box gene promoters prOsMADS1, prOsMADS2, prOsMADS6, prOsMADS7, prOsMADS14; and prOsMADS16 (U.S. Patent Application Publication Nos. 2007/0006344, 2010/0205692 A1, and 2012/0021506 A1); the rice anther-specific promoter prRA8 (see Japanese Patent Application JP 2001512988-A/13); the rice prOsG6 promoter (Tsuchiya et al., 1994); the whole seed-specific promoter disclosed in U.S. Patent Application Publication No. 2012/0036595; and the endosperm promoter disclosed in U.S. Patent Application Publication No. 2012/0036593.

Additional promoters that can be employed with the presently disclosed subject matter include, but are not limited to those described in U.S. Pat. No. 7,151,201; the PsEND1 promoter described in Roque et al., 2007; the corn stamen-specific promoters described in PCT International Patent Application Publication No. WO 1992/013957; and the APETALA3 promoter described in U.S. Pat. No. 7,253,340.

In some embodiments, an inducible promoter might be desired. Inducible promoters drive transcription in response to external stimuli such as chemical agents or environmental stimuli. For example, inducible promoters can confer transcription in response to hormones such as gibberellic acid or ethylene, or in response to light, heat or drought.

In some embodiments, an expression construct further comprises a transcription terminator operably linked to the nucleic acid of interest. These are responsible for the termination of transcription beyond the transgene and/or correct mRNA polyadenylation. A variety of transcriptional terminators are available for use in expression cassettes. The termination region can be native with respect to the transcriptional initiation region/promoter (i.e., the promoter and transcription terminator can be derived from the same genetic locus), can be native with the operably linked DNA sequence of interest, can be native with the plant host, and/or can be derived from another source (e.g., can be foreign or heterologous to the promoter, the DNA sequence of interest, the plant host, or any combination thereof). Exemplary transcriptional terminators are those that are known to function in plants and include the CAMV 35S terminator, the tml terminator, the nopaline synthase (Nos) terminator, and the pea rbcs E9 terminator. These can be used in both monocotyledons and dicotyledons. In addition, a gene's native transcription terminator can be used.

In some embodiments, an expression cassette comprises a selectable marker gene for the selection of transformed cells.

Additionally, various sequences have been found to enhance gene expression from within the transcriptional unit, and in some embodiments these sequences are used in conjunction with the nucleic acids of the presently disclosed subject matter to increase their expression in transgenic plants. For example, certain intron sequences have been shown to enhance expression, particularly in monocotyledonous cells. For example, the introns of the maize Adhl gene have been found to significantly enhance the expression of the wild type gene under its cognate promoter when introduced into maize cells. Intron 1 was found to be particularly effective and enhanced expression in fusion constructs with the chloramphenicol acetyltransferase gene (Callis et al., 1987). In the same experimental system, the intron from the maize bronze 1 gene had a similar effect in enhancing expression of an operably linked nucleic acid sequence. Intron sequences have been routinely incorporated into plant transformation vectors, typically within the non-translated leader.

Expression constructs of the presently disclosed subject matter can also comprise a leader sequence and/or a sequence allowing for inducible expression of the polynucleotide of interest. See e.g., Guo et al., 2003; Chen et al., 2003 for examples of sequences allowing for inducible expression.

A number of non-translated leader sequences derived from viruses are also known to enhance expression of operably linked nucleic acid sequences, and these are particularly effective in dicotyledonous cells. Specifically, leader sequences from Tobacco Mosaic Virus (TMV, the "W-sequence"), Maize Chlorotic Moltle Virus (MCMV), and Alfalfa Mosaic Virus (AMV) have been shown to be effective in enhancing expression (see e.g., Gallie et al., 1987; Skuzeski et al., 1990). Other leader sequences known in the art include, but are not limited to, picornavirus leaders (e.g., the EMCV leader (the encephalomyocarditis 5'-noncoding region); Elroy-Stein et al., 1989); potyvirus leaders (e.g., the Tobacco Etch Virus (TEV) leader; Allison et al., 1986); the Maize Dwarf Mosaic Virus (MDMV) leader (see GENBANK® Accession No. NC_003377); the human immunoglobulin heavy-chain binding protein (BiP) leader (Macejak & Samow, 1991); the untranslated leader from the coat protein mRNA of alfalfa mosaic virus (AMV RNA 4; Jobling & Gehrke, 1987); the tobacco mosaic virus leader (TMV) leader (Gallie et al., 1989); and the Maize Chlorotic Moltle Virus (MCMV) leader (Lommel et al., 1991). See also, Della-Cioppa et al., 1987.

Alternatively or in addition, an expression construct of the present invention can include a presequence that directs the localization polypeptide encoded by the expression construct to an organelle within a plant cell. A nucleotide sequence encoding a presequence can be introduced in frame at the 5' end of a coding sequence in order to target the polypeptide encoded by the presequence/coding sequence hybrid to the target area. In some embodiments, the coding sequence encodes a subsequence or the entire sequence set forth in SEQ ID NO: 54. In some embodiments 454 amino acids of SEQ ID NO: 54 or a subsequence thereof that comprised amino acids non HI trait or or less consecutive amino acids or more consecutive amino acids or an amino acid sequence that is 95% identical thereto can be fused to any presequence using standard molecular cloning techniques.

The transformation of non HI; or HI germplasm can include transformants in monocots and dicots which may be for example orthologs. Species that have orthologues to this sequence can readily be employed in the transformation process these include but are not limited to the species: *Sorghum bicolor*, maize, wheat, millet, *Setaria Italica*, *Oryza brachyantha*, *Oryza indica*, *Oryza glaberrima*, *Hordeum vulgare*, *Oryza sativa*, *Solanum lycopersicum* (tomato), and *Brachypodium distachyon*.

In some embodiments, the presently disclosed subject matter provides markers for detecting and/or assaying for the presence or absence of gene products associated with HI in a plant cell or other source of biomolecules. In some embodiments, a marker is intended to detect the presence of a nucleic acid molecule that includes the deletion junction where the maize HI sequences show an insertion in the sequence in SEQ ID NO. 53 to allow for the specific detection of the presence or absence of a chimeric nucleic acid comprising SEQ ID NO: 33, SEQ ID NO: 37, SEQ ID NO: 52 or SEQ ID NO: 53 in a sample. The number of nucleotides 5' and/or 3' of the deletion junction that allow for specific detection of the presence of absence of a chimeric nucleic acid comprising SEQ ID NO: 53 in a sample can vary based on the identification method employed, but can be in some embodiments at least about 5 nucleotides, in some embodiments at least about 10 nucleotides, in some embodiments at least about 15 nucleotides, in some embodiments at least about 20 nucleotides, in some embodiments at least about 25 nucleotides, and in some embodiments at least about 50 nucleotides 5' and/or 3' to the insertion junction on either side of nucleotides 1230-1233 in SEQ ID NO: 53 should have fit within the HI Locus and does appear in the nonHI locus at this position. In some embodiments, an informative fragment of SEQ ID NO: 33, SEQ ID NO: 37, SEQ ID NO: 52 or SEQ ID NO: 53 can be a marker as defined herein below. A marker which tracks the lesion which causes the phenotype will be superior to any marker which is merely linked because the marker to the causative lesion will never disassociate from the phenotype. Linked markers can and become disassociated by a recombination event.

The presently disclosed subject matter also provides reagents for use in detecting and/or assaying for the presence of gene products associated with HI in a plant cell or other source of biomolecules. Such reagents can include in some embodiments an amplification primer pair capable of amplifying a plant nucleic acid template to generate a marker amplicon, wherein the marker amplicon corresponds to a marker comprising an informative subsequence of SEQ ID NO: 33, SEQ ID NO: 37, SEQ ID NO: 52 or SEQ ID NO: 53, wherein the informative subsequence permits identification of the presence or absence of an allele associated with HI in a plant. By way of example and not limitation, such a amplification primer pair can be designed with a forward primer that is located 5' to the fusion junction and a reverse primer that is located 3' to the fusion junction present in SEQ ID NO: 53. Such an amplification primer pair would not be expected to amplify a gene product derived from a wildtype maize non HI locus.

In some embodiments, one or more amplification primer pairs of the presently disclosed subject matter are provided in the form of a kit, wherein the kit further comprises one or more positive and/or negative amplification primer pairs (such as but not limited to an amplification primer pair designed to amplify a wild type (HI) gene product), instructions for employing the amplification primer pairs, and/or one or more additional reagents necessary for performing an amplification reaction (e.g., a DNA polymerase, a reverse transcriptase, a buffer solution, etc.).

Thus, in some embodiments, a method for detecting and/or assaying for the presence of gene products associated with HI in a plant cell or other source of biomolecules can employ the polymerase chain reaction (PCR) using appropriately designed primers to detect the presence in a plant cell or other source of biomolecules of a gene product associated with HI (including, but not limited to a gene product comprising SEQ ID NO: 33, SEQ ID NO: 37, SEQ ID NO: 52 or SEQ ID NO: 53 or an informative fragment thereof. It is understood that other molecular biological techniques can also be employed for this purpose including, but not limited to TAQMAN® assays, KASPAR™ assays, ILLUMINA® GOLDENGATE® assays, etc.

In some embodiments, the presently disclosed subject matter provides methods for diagnostic determination of whether a plant having such DNA will or will not exhibit HI and/or producing plants that exhibit HI. In some embodiments, the methods comprise (a) transforming a plant cell with an expression cassette as disclosed herein to produce a transformed plant cell; and (b) generating a plant from the transformed plant cell.

In some embodiments, a plant cell is stably transformed with an expression cassette of the presently disclosed subject matter. "Stable transformation" or "stably transformed" is intended to mean that a polynucleotide, for example, an expression cassette as described herein, introduced into a plant integrates into the genome of the plant and is capable of being inherited by the progeny thereof, more particularly, by the progeny of multiple successive generations.

Numerous transformation vectors available for plant transformation are known to those of ordinary skill in the plant transformation arts, and the nucleic acids pertinent to the presently disclosed subject matter can be used in conjunction with any such vectors. The selection of a vector will depend upon the transformation technique to be employed and the target species for transformation. For certain target species, different antibiotic or herbicide selection markers might be preferred. Selection markers used routinely in transformation include the nptII gene, which confers resistance to kanamycin and related antibiotics (Viera & Messing, 1982; Bevan et al., 1983); the pat and bar genes, which confer resistance to the herbicide glufosinate (also called phosphinothricin; see White et al., 1990; Spencer et al., 1990; and U.S. Pat. Nos. 5,561,236 and 5,276,268); the hph gene, which confers resistance to the antibiotic hygromycin (Blochinger & Diggelmann, 1984), and the dhfr gene, which confers resistance to methatrexate (Bourouis & Jarry, 1983); the EPSPS gene, which confers resistance to glyphosate (U.S. Pat. Nos. 4,940,935 and 5,188,642); the glyphosate N-acetyltransferase (GAT) gene, which also confers resistance to glyphosate (Castle et al., 2004; U.S. Patent Application Publication Nos. 2005/0060767, 2005/0246798, and 2007/0004912); and the mannose-6-phosphate isomerase gene, which provides the ability to metabolize mannose (U.S. Pat. Nos. 5,767,378 and 5,994,629), the gene encoding a mutant D-amino acid oxidase which can be derived from *Rhodotorula gracilis*, with a lysine at position 58 rather than a phenylalanine which interacts with D-phosphinothricin to produce a toxin (U.S. Pat. No. 7,939,709).

Thus, in some embodiments the presently disclosed subject matter relates to inducing HI in a plant. In some embodiments, a general technique for producing plants that exhibit HI comprises transforming a plant cell with an expression cassette to produce a transformed plant cell, wherein the expression cassette encodes an RNAi construct targeted to a gene associated with HI; and (b) generating a plant from the transformed plant cell. After a plant cell is transformed with an expression vector or expression cassette encodes an RNAi construct targeted to a gene associated with HI, a whole plant or plant tissue can be regenerated, if desired. Methods for regeneration of plants are also well known in the art. For example, Ti plasmid vectors have been utilized for the delivery of foreign DNA, as well as direct DNA uptake, liposomes, electroporation, microinjection, and microprojectiles. In addition, bacteria from the genus *Agrobacterium* can be utilized to transform plant cells. Below are descriptions of representative techniques for transforming both dicotyledonous and monocotyledonous plants, as well as a representative plastid transformation technique.

Many vectors are available for transformation using *Agrobacterium tumefaciens*. These typically carry at least one T-DNA border sequence and include vectors such as pBIN19 (Bevan, 1984). For the construction of vectors useful in *Agrobacterium* transformation, see e.g., U.S. Patent Application Publication No. 2006/0260011. See also Lee & Glevin, 2008.

Transformation without the use of *Agrobacterium tumefaciens* circumvents the requirement for T-DNA sequences in the chosen transformation vector and consequently vectors lacking these sequences can be utilized in addition to vectors such as the ones described above which contain one or more T-DNA sequences. Transformation techniques that do not rely on *Agrobacterium* include transformation via particle bombardment, protoplast uptake (e.g., PEG and electroporation), whiskering, and microinjection. The choice of vector depends largely on the chosen selection for the species being transformed. For the construction of such vectors, see e.g., U.S. Patent Application Publication No. 2006/0260011.

For expression of a nucleotide sequence of the presently disclosed subject matter in plant plastids, plastid transformation vector pPH143 (PCT International Patent Application Publication No. WO 1997/32011, example 36) can be used. The nucleotide sequence is inserted into pPH143 thereby replacing the PROTOX coding sequence.

Transformation techniques for dicotyledons are well known in the art and include *Agrobacterium*-based techniques and techniques that do not require *Agrobacterium*. Non-*Agrobacterium* techniques involve the uptake of exogenous genetic material directly by protoplasts or cells. This can be accomplished by PEG or electroporation mediated uptake, particle bombardment-mediated delivery, and/or microinjection. Examples of these techniques are described by Paszkowski et al., 1984; Potrykus et al., 1985; Reich et al., 1986; and Klein et al., 1987. In each case the transformed cells are regenerated to whole plants using standard techniques known in the art.

*Agrobacterium*-mediated transformation is a preferred technique for transformation of dicotyledons because of its high efficiency of transformation and its broad utility with many different species. *Agrobacterium* transformation typically involves the transfer of the binary vector carrying the foreign DNA of interest (e.g., pCIB200 or pCIB2001) to an appropriate *Agrobacterium* strain which may depend of the complement of vir genes carried by the host *Agrobacterium* strain either on a co-resident Ti plasmid or chromosomally (e.g., strain CIB542 for pCIB200 and pCIB2001 (Uknes et al., 1993). The transfer of the recombinant binary vector to *Agrobacterium* is accomplished by a triparental mating procedure using *E. coli* carrying the recombinant binary vector, a helper *E. coli* strain which carries a plasmid such as pRK2013 and which is able to mobilize the recombinant binary vector to the target *Agrobacterium* strain. Alternatively, the recombinant binary vector can be transferred to *Agrobacterium* by DNA transformation (Hofgen & Willmitzer, 1988).

Transformation of the target plant species by recombinant *Agrobacterium* usually involves co-cultivation of the *Agrobacterium* with explants from the plant and follows protocols well known in the art. Transformed tissue is regenerated on selectable medium carrying the antibiotic or herbicide resistance marker present between the binary plasmid T-DNA borders.

Another approach to transforming plant cells with a gene involves propelling inert or biologically active particles at plant tissues and cells. Variations of this technique are disclosed in U.S. Pat. Nos. 4,945,050, 5,036,006, and 5,100,792 all to Sanford et al. Generally, this procedure involves propelling inert or biologically active particles at the cells under conditions effective to penetrate the outer surface of the cell and afford incorporation within the interior thereof. When inert particles are utilized, the vector can be introduced into the cell by coating the particles with the vector containing the desired gene. Alternatively, the target cell can be surrounded by the vector so that the vector is carried into the cell by the wake of the particle. Biologically active particles (e.g., dried yeast cells, dried bacterium, or a bacteriophage, each containing DNA sought to be introduced) can also be propelled into plant cell tissue.

Transformation of most monocotyledon species has now also become routine. Exemplary techniques include direct gene transfer into protoplasts using PEG or electroporation techniques, and particle bombardment into callus tissue. Transformations can be undertaken with a single DNA species or multiple DNA species (i.e., co-transformation), and both of these techniques are suitable for use with the presently disclosed subject matter. Co-transformation can have the advantage of avoiding complete vector construction and of generating transgenic plants with unlinked loci for the gene of interest and the selectable marker, thereby permitting the removal of the selectable marker in subsequent generations, should this be regarded desirable. However, a disadvantage of the use of co-transformation can be the less than 100% frequency with which separate DNA species are integrated into the genome (Schocher et al. Biotechnology 4: 1093-1096 (1986)).

European Patent Applications EP 0 292 435 and EP 0 392 225, and PCT International Patent Application Publication No. WO 1993/07278 describe techniques for the preparation of callus and protoplasts from an elite inbred line of maize, transformation of protoplasts using PEG or electroporation, and the regeneration of maize plants from transformed protoplasts. Gordon-Kamm et al., 1990) and Fromm et al., 1990 have published techniques for transformation of A188-derived maize line using particle bombardment. Furthermore, PCT International Patent Application Publication No. WO 1993/07278 and Koziel et al., 1993 describe techniques for the transformation of elite inbred lines of maize by particle bombardment. This technique utilizes immature maize embryos of 1.5-2.5 mm length excised from a maize ear 14-15 days after pollination and a BIOLISTIC® PDS-1000/He (Bio-Rad Laboratories, Hercules, California, United States of America) device for bombardment.

Transformation of rice can also be undertaken by direct gene transfer techniques utilizing protoplasts or particle bombardment. Protoplast-mediated transformation has been described for *Japonica*-types and Indica-types (Zhang et al., 1988; Shimamoto et al., 1989; Datta et al., 1990). Both types are also routinely transformable using particle bombardment (Christou et al., 1991). Furthermore, PCT International Patent Application Publication No. WO 1993/21335 describes techniques for the transformation of rice via electroporation.

European Patent Application EP 0 332 581 describes techniques for the generation, transformation and regeneration of Pooideae protoplasts. These techniques allow the transformation of *Dactylis* and wheat. Furthermore, wheat transformation has been described by Vasil et al., 1992 using particle bombardment into cells of type C long-term regenerable callus, and also by Vasil et al., 1993 and Weeks et al., 1993 using particle bombardment of immature embryos and immature embryo-derived callus. An exemplary technique for wheat transformation, however, involves the transformation of wheat by particle bombardment of immature embryos and includes either a high sucrose or a high maltose step prior to gene delivery. Prior to bombardment, any number of embryos (0.75-1 mm in length) are plated onto MS medium with 3% sucrose (Murashige & Skoog, 1962) and 3 mg/l 2,4-D for induction of somatic embryos, which is allowed to proceed in the dark. On the chosen day of bombardment, embryos are removed from the induction medium and placed onto the osmoticum (i.e., induction medium with sucrose or maltose added at the desired concentration, typically 15%). The embryos are allowed to plasmolyze for 2-3 hours and are then bombarded. Twenty embryos per target plate is typical, although not critical. An appropriate gene-carrying plasmid (such as pCIB3064 or pSOG35) is precipitated onto micrometer size gold particles using standard procedures. Each plate of embryos is shot with the DuPont BIOLISTICS® helium device using a burst pressure of about 1000 psi using a standard 80 mesh screen. After bombardment, the embryos are placed back into the dark to recover for about 24 hours (still on osmoticum). After 24 hours, the embryos are removed from the osmoticum and placed back onto induction medium where they stay for about a month before regeneration. Approximately one month later the embryo explants with developing embryogenic callus are transferred to regeneration medium (MS+1 mg/liter NAA, 5 mg/liter GA), further containing the appropriate selection agent (10 mg/l basta in the case of pCIB3064 and 2 mg/l methotrexate in the case of pSOG35). After approximately one month, developed shoots are transferred to larger sterile containers known as "GA7s" which contain half-strength MS, 2% sucrose, and the same concentration of selection agent.

Transformation of monocotyledons using *Agrobacterium* has also been described. See e.g., PCT International Patent Application Publication No. WO 1994/00977 and U.S. Pat. No. 5,591,616. See also Negrotto et al., Plant Cell Reports 19: 798-803 (2000), incorporated herein by reference.

For example, rice (*Oryza sativa*) can be used for generating transgenic plants. Various rice cultivars can be used (Hiei et al., 1994; Dong et al., 1996; Hiei et al., 1997). Also, the various media constituents described below can be either varied in quantity or substituted. Embryogenic responses are initiated and/or cultures are established from mature embryos by culturing on MS-CIM medium (MS basal salts, 4.3 g/liter; B5 vitamins (200×), 5 ml/liter; Sucrose, 30 g/liter; proline, 500 mg/liter; glutamine, 500 mg/liter; casein hydrolysate, 300 mg/liter; 2,4-D (1 mg/ml), 2 ml/liter; adjust pH to 5.8 with 1 N KOH; PHYTAGEL™ plant tissue culture reagent, 3 g/liter). Either mature embryos at the initial stages of culture response or established culture lines are inoculated and co-cultivated with the *Agrobacterium tumefaciens* strain LBA4404 (*Agrobacterium*) containing the desired vector construction. *Agrobacterium* is cultured from glycerol stocks on solid YPC medium (100 mg/L spectinomycin and any other appropriate antibiotic) for about 2 days at 28° C. *Agrobacterium* is resuspended in liquid MS-CIM medium. The *Agrobacterium* culture is diluted to an $OD_{600}$ of 0.2-0.3 and acetosyringone is added to a final concentration of 200 μM. Acetosyringone is added before mixing the solution with the rice cultures to induce *Agrobacterium* for DNA transfer to the plant cells. For inoculation, the plant cultures are immersed in the bacterial suspension. The liquid bacterial suspension is removed and the inoculated cultures are placed on co-cultivation medium and incubated at 22° C. for two days. The cultures are then transferred to MS-CIM medium with Ticarcillin (400 mg/liter) to inhibit the growth of *Agrobacterium*. For constructs utilizing the PMI selectable marker gene (Reed et al., 2001), cultures are transferred to selection medium containing Mannose as a carbohydrate source (MS with 2% Mannose, 300 mg/liter Ticarcillin) after 7 days, and cultured for 3-4 weeks in the dark. Resistant colonies are then transferred to regeneration induction medium (MS with no 2,4-D, 0.5 mg/liter IAA, 1 mg/liter zeatin, 200 mg/liter timentin, 2% Mannose, and 3% Sorbitol) and grown in the dark for 14 days. Proliferating colonies are then transferred to another round of regeneration induction media and moved to the light growth room. Regenerated shoots are transferred to GA7 containers with GA7-1 medium (MS with no hormones and 2% Sorbitol) for 2 weeks and then moved to the greenhouse when they are large enough and have adequate roots. Plants are transplanted to soil in the greenhouse (To generation) grown to maturity, and the $T_1$ seed is harvested.

The plants obtained via transformation with a nucleic acid sequence of interest in the presently disclosed subject matter can be any of a wide variety of plant species, including those of monocots and dicots. The plants used in the methods of the presently disclosed subject matter are in some embodiments selected from the list of agronomically important target crops set forth elsewhere herein. The expression of a nucleic acid of the presently disclosed subject matter in combination with other characteristics important for production and quality can be incorporated into plant lines through breeding. Breeding approaches and techniques are known in the art. See e.g., Welsh, 1981; Wood, 1983; Mayo, 1987; Singh, 1986; and Wricke & Weber, 1986.

For the transformation of plastids, seeds of *Nicotiana tabacum* c.v. "Xanthienc" are germinated seven per plate in a 1" circular array on T agar medium and bombarded 12-14 days after sowing with 1 um tungsten particles (M10, Biorad Laboratories, Hercules, California, United States of America) coated with DNA from plasmids pPH143 and pPH145 essentially as described in Svab & Maliga, 1993. Bombarded seedlings are incubated on T medium for two days after which leaves are excised and placed abaxial side up in bright light (350-500 μmol photons/m$^2$/s) on plates of RMOP medium (see Svab et al., 1990) containing 500 μg/ml spectinomycin dihydrochloride (Sigma, St. Louis, Missouri, United States of America). Resistant shoots appearing underneath the bleached leaves three to eight weeks after bombardment are subcloned onto the same selective medium, allowed to form callus, and secondary shoots isolated and subcloned. Complete segregation of transformed plastid genome copies (homoplasmicity) in independent subclones is assessed by standard techniques of Southern blotting (see Sambrook & Russell, 2001). BamHI/EcoRI-digested total cellular DNA (Mettler, 1987) is separated on 1% Tris-borate (TBE) agarose gels, transferred to nylon or nitrocellulose membranes, and probed with $^{32}$P-labeled random-primed DNA sequences corresponding to a 0.7 kb BamHI/HindIII DNA fragment from pC8 containing a portion of the rps 7/12 plastid targeting sequence. Homoplasmic shoots are rooted aseptically on spectinomycin-containing MS/IBA medium (McBride et al., 1994) and transferred to the greenhouse.

To test the haploid induction capacity of newly created lines, the pollen from each line is to be crossed onto an ear to induce fertilization, and the resulting progeny of the cross subjected to ploidy analysis. Ploidy analysis can be defined in this case as any experimental test where the ploidy level of an individual plant is determined. In crosses between two non-inducing lines, the resulting progeny should be almost exclusively diploid, or 2N. However, if a haploid induction line is the male parent, the resulting progeny will be a mixed population of haploids (1N), diploids (2N), aneuploids (somewhere between 1N and 2N), and chimeras (containing tissues with mixed ploidy). The determination of haploid induction capacity can be made binary by setting a cutoff value for the haploid induction rate, which is defined as the number of haploid embryos over the total number of viable embryos. The rate should be at least greater than 0.5%, and for high stringency, a good cutoff off is greater than 1% haploids. This is because a natural 'background' haploid induction rate of around 0.1% exists in maize. Because haploidy is only induced through the male parent during in vivo maize haploid induction, the female simply serves as a "tester" and thus, the female germplasm could be any number of lines. The female tester could be the inducer line itself (and the cross would thus be a self hybridization), or the tester could be any inbred, hybrid, or backcrossed maize line. The ploidy analysis can involve different methods, as described below.

One method of plant ploidy analysis is to evaluate the phenotypic characteristics of the plant, paying attention to those characteristics associated with haploidy, including but not limited to short plant stature, altered phylotaxy, smaller leaf width, low overall body mass, and male sterility. Plants could be given a score on each characteristic and then the scores could be added together and compared to known haploid and diploid controls. In another embodiment, the embryos resulting from a haploid induction cross may be extracted mechanically from immature kernels anytime between day 9 and day 20 after pollination, and then subjected to ploidy analysis by a ploidy analyzer (Partec) which uses DAPI stain combined with flow cytometry to quantify the total DNA amount per cell. In one embodiment, embryonic and/or scutellar tissue is used for processing; in another embodiment, adult plant tissues including roots, leaves, stems, or flowers are used. In one embodiment, the selected tissues are chopped up with a razor blade, incubated in an extraction buffer, filtered through a nylon mesh filter and then incubated in a DAPI stain before loading into the ploidy analyzer. In another embodiment, embryonic or adult tissue including those described above is first digested into protoplasts using a combination of cellulose and maceroenzyme in a buffer solution, then filtered and incubated in DAPI.

In yet another method of ploidy analysis, microscopic imaging of mature, juvenile, or embryonic plant tissues can be used to identify the ploidy by counting the number of chromosomes in certain cells that are undergoing mitosis. The DNA in this case may be stained with DAPI or any other common DNA stain such as propidium iodide. In maize a diploid plant will have 20 chromosomes per cell while a haploid plant will have 10 per cell. In such an approach, the embryos can be incubated on media for anywhere from zero to fourteen days, during which many embryos may germinate and grow small rootlets.

Alone or in combination with any of the ploidy analysis methods described above, the putative novel haploid induction line may be first crossed to a marker line, including but not limited to lines that contain the R1-navajo (R1-nj) or R1-scutellum2 (R1-Scm2) markers, or any line having DNA that encode for protein products that confer a visual identifier, such as a color visible to the human eye (e.g. anthocyanin) or a fluorescence-based marker visible only via fluorescent microscopy. Such markers, having been introgressed into the putative haploid inducer line, can serve as evidence of the existence of the paternal genome in progeny indicating a diploid state, with absence indicating a haploid state. The presence or absence of the marker may be detected using a visual test or microscopy.

The presently disclosed subject matter also provides methods for identifying the presence or absence of an allele associated with HI in a plant. In some embodiments, the methods comprise (a) obtaining a sample from the plant comprising genomic and/or nuclear DNA and/or an RNA product derived therefrom; (b) contacting the sample with a pair of primers that, when used in a nucleic-acid amplification reaction with a nucleic acid sample from the plant, produces an amplicon that can be used to identify the presence or absence of an allele associated with HI; (c) amplifying a fragment from said sample using the primer pair of (b), wherein the primer pair is complementary and binds to the nucleotide sequence of (b); and (d) detecting an amplicon that can be used to identify the presence or absence of an allele associated with HI in the plant.

The presently disclosed subject matter also provides methods for introgressing HI-inducing nucleotide sequences into plants. In some embodiments, the methods comprise crossing a first plant with a second plant to produce a third plant, wherein the genome of the first plant or the second plant comprises a recombinant nucleic acid sequence encoding a HI-associated gene product of the presently disclosed subject matter. In some embodiments, the methods further comprise assaying the genome of the third plant for the presence of the recombinant nucleic acid sequence encoding the HI-associated gene product. In some embodiments, the recombinant nucleic acid comprises (a) a nucleic acid having at least 90% identity to SEQ ID NO: 33, optionally wherein the percent identity is calculated over the entire length of SEQ ID NO: 33; (b) a nucleic acid having at least 95% identity over nucleotides 91-1452 of SEQ ID NO: 33; (c) a nucleic acid that is the reverse complement of either of (a) or (b); (d) a nucleic acid that encodes a polypeptide comprising an amino acid sequence that is at least 95% identical to SEQ ID NO: 54, SEQ ID NO: 55, SEQ ID NO: 56 or SEQ ID NO: 57 optionally wherein the percent identity is calculated over the entire length of SEQ ID NO: 54, SEQ ID NO: 55, SEQ ID NO: 56 or SEQ ID NO: 57 respectively; and, (e) a sequence having at least 90% identity to SEQ ID NO: 32, optionally wherein the percent identity is calculated over the entire length of SEQ ID NO: 32; (f) a sequence having at least 95% identity over nucleotides 1-1795 of SEQ ID NO: 32; (g) a nucleic acid sequence that is the reverse complement of either of (e) or (f). In some embodiments, the recombinant nucleic acid encodes an amino acid sequence that comprises all or substantially all of amino acids 1-454 of SEQ ID NO: 54.

The presently disclosed subject matter also provides methods for selecting $F_0$ parental plants that are predicted to produce subsequent (e.g., $F_1$, $F_2$, $F_3$, etc.) generations with plants that exhibit HI. In some embodiments, the methods comprise identifying in the the absence of sequence in the genome of an $F_0$ plant a nucleic acid comprising a sequence selected from the group consisting of. The presently disclosed subject matter also provides kits for detecting the presence or absence of a HI-inducing allele in a plant. In some embodiments, the kits comprise one or more nucleic acid- and/or amino acid-based reagents derived from the maize HI locus or from a locus linked thereto, wherein the one or more nucleic acid- and/or amino acid-based reagents are designed to be employed in a nucleic acid- and/or amino acid-based assay for the presence or absence in the plant (a) a nucleic acid having at least 90% identity to SEQ ID NO: 33, optionally wherein the percent identity is calculated over the entire length of SEQ ID NO: 33; (b) a nucleic acid having at least 95% identity over nucleotides 91-1452 of SEQ ID NO: 33; (c) a nucleic acid that is the reverse complement of either of (a) or (b); (d) a nucleic acid that encodes a polypeptide comprising an amino acid sequence that is at least 95% identical to SEQ ID NO: 54, SEQ ID NO: 55, SEQ ID NO: 56 or SEQ ID NO: 57 optionally wherein the percent identity is calculated over the entire length of SEQ ID NO: 54, SEQ ID NO: 55, SEQ ID NO: 56 or SEQ ID NO: 57 respectively; and, (e) a sequence having at least 90% identity to SEQ ID NO: 32, optionally wherein the percent identity is calculated over the entire length of SEQ ID NO: 32; (f) a sequence having at least 95% identity over nucleotides 1-1795 of SEQ ID NO: 32; (g) a nucleic acid sequence that is the reverse complement of either of (e) or (f). In some embodiments, the recombinant nucleic acid encodes an amino acid sequence that comprises all or substantially all of amino acids 1-454 of SEQ ID NO: 54.

In some embodiments, the one or more nucleic acid- and/or amino acid-based reagents derived from the maize HI locus or from a locus linked thereto comprise one or more oligonucleotide primers that are diagnostic of the presence in the plant of in the plant of the nucleic acid having at (a) a nucleic acid having at least 90% identity to SEQ ID NO: 33, optionally wherein the percent identity is calculated over the entire length of SEQ ID NO: 33; (b) a nucleic acid having at least 95% identity over nucleotides 91-1452 of SEQ ID NO: 33; (c) a nucleic acid that is the reverse complement of either of (a) or (b); (d) a nucleic acid that encodes a polypeptide comprising an amino acid sequence that is at least 95% identical to SEQ ID NO: 54, SEQ ID NO: 55, SEQ ID NO: 56 or SEQ ID NO: 57 optionally wherein the percent identity is calculated over the entire length of SEQ ID NO: 54, SEQ ID NO: 55, SEQ ID NO: 56 or SEQ ID NO: 57 respectively; and, (e) a sequence having at least 90% identity to SEQ ID NO: 32, optionally wherein the percent identity is calculated over the entire length of SEQ ID NO: 32; (f) a sequence having at least 95% identity over nucleotides 1-1795 of SEQ ID NO: 32; (g) a nucleic acid sequence that is the reverse complement of either of (e) or (f). In some embodiments, the recombinant nucleic acid encodes an amino acid sequence that comprises all or substantially all of amino acids 1-454 of SEQ ID NO: 54.

As used herein, a "nucleic acid- or amino acid-based reagent" of the presently disclosed subject matter refers to any nucleic acid, peptide, or polypeptide that can be used to detect the presence or absence of SEQ ID NO: 33, SEQ ID NO: 37, SEQ ID NO: 52 or SEQ ID NO: 53 or an informative fragment thereof in a plant in any type of assay. By way of example and not limitation, a nucleic acid-based reagent of the presently disclosed subject matter can be an oligonucleotide primer pair that is designed to flank the deletion junction such that an amplification product will occur only if (a) a nucleic acid having at least 90% identity to SEQ ID NO: 33, optionally wherein the percent identity is calculated over the entire length of SEQ ID NO: 33; (b) a nucleic acid having at least 95% identity over nucleotides 91-1452 of SEQ ID NO: 33; (c) a nucleic acid that is the reverse complement of either of (a) or (b); (d) a nucleic acid that encodes a polypeptide comprising an amino acid sequence that is at least 95% identical to SEQ ID NO: 54, SEQ ID NO: 55, SEQ ID NO: 56 or SEQ ID NO: 57 optionally wherein the percent identity is calculated over the entire length of SEQ ID NO: 54, SEQ ID NO: 55, SEQ ID NO: 56 or SEQ ID NO: 57 respectively; and, (e) a sequence having at least 90% identity to SEQ ID NO: 32, optionally wherein the percent identity is calculated over the entire length of SEQ ID NO: 32; (f) a sequence having at least 95% identity over nucleotides 1-1795 of SEQ ID NO: 32; (g) a nucleic acid sequence that is the reverse complement of either of (e) or (f). In some embodiments, the recombinant nucleic acid encodes an amino acid sequence that comprises all or substantially all of amino acids 1-454 of SEQ ID NO: 54.

Similarly, an amino acid-based reagent of the presently disclosed subject matter can be, but is not limited to, an antibody that binds to a polypeptide having SEQ ID NO: 54, SEQ ID NO: 55, SEQ ID NO: 56 or SEQ ID NO: 57 or an informative fragment thereof. In some embodiments, an antibody that binds to both a polypeptide of SEQ ID NO: 54, SEQ ID NO: 55, SEQ ID NO: 56 or SEQ ID NO: 57 and a maize HI gene product can be employed, wherein in an appropriate assay (e.g., a Western blot or an SDS-PAGE gel), the polypeptide of SEQ ID NO: 54, SEQ ID NO: 55, SEQ ID NO: 56 or SEQ ID NO: 57 and its absence or presence shows the maize HI gene product can be distinguished. In some embodiments, the kit further comprises a set of instructions for performing an assay with the nucleic acid- or amino acid-based reagent. In some embodiments, the kit further comprises one or more additional reagents that can be employed in the performance of the assay with the nucleic acid- or amino acid-based reagent.

EXAMPLE

The following Examples provide illustrative embodiments of the presently disclosed subject matter. In light of the present disclosure and the general level of skill in the art, those of skill will appreciate that the following examples are intended to be exemplary only and that numerous changes, modifications, and alterations can be employed without departing from the scope of the presently disclosed subject matter.

Example 1

QTL Mapping Material Choices

Two mapping populations involving a haploid inducer inbred (RWK) and two non-inducer inbreds (NP2391, NP2460) were generated. RWK was selected because of its high haploid induction ability compared to stock 6. The two non-inducer lines were selected due to existence of extensive data relevant to them. The recombinant inbred populations were backcross populations (BC1) such that the theoretical allele content was 75% RWK and 25% NP2391 for the first population (138 RILs, Recombinant Inbred Lines) and 75% RWK and 25% NP2460 for the second population (123 RILs). The mapping populations were self-pollinated two generations to make the BC1F3. The subsequent BC1F4 plants were testcrossed onto eight plants in two tester rows. The testcrosses were harvested and bulk shelled. Approximately 500 kernels of testcross seed were planted for each entry to observe the number of haploid and diploid plants and thereby determine the haploid induction rate of each recombinant inbred entry within that population.

QTL analysis was performed for both the populations using a version of "QTL Cartographer" software by combining the testcross induction rates with the SNP genotyping data of RILs. QTLs were declared when the LOD score is higher than 2. In total about ~70% variation in haploid induction rate was explained by QTL Bin 1.04. A number of other QTLs were also detected but these accounted for less of the variation. The two important values in QTL studies are the LOD (logarithm of odds) and the $R^2$. A high LOD value represents greater statistical evidence for the present of a QTL, and a higher $R^2$ indicates that the particular QTL has more effect on the trait of interest. The major QTL detected was on Chromosome 1, in a somewhat different region of Chromosome 1 than what was previously indicated by a patent application publication. Additional information about the fine mapping is provided in the subsequent examples.

TABLE 2

Breeding-Mapping Strategy

| Season | What | Result |
|---|---|---|
| Year 0 | F1 | Two non-inducers inbreds (NP2391; P2460) were crossed with RWK |
| Year 0 | F1->BC1 | Both F1 backcrossed to RWK |
| Year 1 | BC1F1->BC1F2 | |
| Year 1 | BC1F2->BC1F3 | |
| Year 1 | BC1F4 testcrosses made × 2 testers | Two mapping Populations × two testers |
| Year 1 | BC1F4 testcrosses phenotyped | QTL Bin 1.04 identified, ~70% variation explained |
| Year 1 | BC2 made | |
| Year 2 | BC3 made | |

TABLE 2-continued

Breeding-Mapping Strategy

| Season | What | Result |
|---|---|---|
| Year 2 | BC3F2 made | |
| Year 2 | BC3F3 testcrosses made × 2 testers | Two fine mapping Populations × two testers |
| Year 3 | BC3F3 testcrosses phenotyped | First fine mapping completed |
| Year 3 | BC3F4 testcrosses made × 2 testers | |
| Year 3 | BC3F4 testcrosses phenotyped | Second fine mapping completed |
| Year 4 | BC3F5 testcrosses made × 2 testers | |
| Year 5 | BC3F5 testcrosses phenotyped | Fine mapping completed |
| Year 5 | RWK, RWK-NIL, Stock 6 gemones sequences | Annotations |

Example 2

Development of Near Isogenic Lines

To accurately position and fine-map the QTL for Haploid induction, near isogenic lines (NIL's) are created by back-crossing to RWK for three generations and followed by selfing for another 3 generations. During this process several NIL's were created in RWK background with regions from NP2391 and NP2460 in the target QTL region. This particular strategy was utilized to create NIL's because, haploid induction efficiency can change with the background and also to keep the rest of the RWK genome mostly uniform while focusing on the small non-inducer chromosome regions that were back-crossed into RWK.

Example 3

Fine Mapping

When the experiment was initiated, the haploid induction locus was localized in a region of 3.3 MB containing approximately 90 putative genes within that interval. The fine mapping process reduced the haploid induction locus to a 0.88 MB region with twenty five annotated genes. Additional fine mapping reduced the haploid induction locus to a 0.60 region. The BC3F3 plants described in the above examples, which were heterozygous at the region of interest were selfed to create additional recombinations. These BC3F4 recombinants were testcrossed with two different testers and phenotypic information was gathered by measuring their haploid induction (HI) ability. The genotypic information from this localized haploid induction region and the phenotypic information taken concerning these line's haploid induction ability were correlated to fine-map the haploid induction locus to a 0.60 MB region with fewer than 7 annotated genes.

TABLE 3

FINE MAPPING

| Old interval | New Confidence interval | Refined interval | Gene_ID | transcript_start | transcript_end | transcript_strand |
|---|---|---|---|---|---|---|
| x | x | x | GRMZM2G305400 | 67991172 | 67994092 | −1 |
| x | x | x | GRMZM2G082836 | 68107606 | 68110989 | 1 |
| x | x | x | GRMZM2G382717 | 68113455 | 68115168 | −1 |
| x | x | x | GRMZM2G120587 | 68133178 | 68136953 | −1 |
| x | x | x | GRMZM2G471240 | 68240862 | 68242656 | 1 |
| x | x | x | GRMZM2G471240 | 68240862 | 68242656 | 1 |
| x | x | x | GRM2M2G062320 | 68318898 | 68321409 | 1 |
| x | x |   | GRMZM5G866758 | 68430654 | 68436197 | 1 |
| x | x |   | GRMZM5G866758 | 68430654 | 68436197 | 1 |
| x | x |   | GRMZM2G003530 | 68435670 | 68439997 | −1 |
| x |   |   | GRMZM2G077991 | 68543246 | 68546264 | −1 |
| x |   |   | GRMZM2G077991 | 68543694 | 68546264 | −1 |
| x |   |   | GRMZM2G077991 | 68543805 | 68546269 | −1 |
| x |   |   | GRMZM2G077960 | 68554980 | 68559182 | 1 |
| x |   |   | GRMZM2G077897 | 68561209 | 68565155 | −1 |
| x |   |   | GRMZM2G347583 | 68660278 | 68665995 | 1 |
| x |   |   | GRMZM2G173030 | 68668900 | 68671460 | 1 |
| x |   |   | GRMZM2G022061 | 68876150 | 68882226 | 1 |
| x |   |   | GRMZM2G022061 | 68876150 | 68882226 | 1 |
| x |   |   | GRMZM2G022061 | 68876150 | 68882226 | 1 |
| x |   |   | GRMZM2G022061 | 68876150 | 68882226 | 1 |
| x |   |   | GRMZM2G022061 | 68876150 | 68882226 | 1 |
| x |   |   | GRMZM2G340286 | 68928213 | 68929600 | 1 |
| x |   |   | GRMZM2G340279 | 68934652 | 68937080 | −1 |
| x |   |   | GRMZM2G347808 | 69005208 | 69012612 | 1 |

Example 4

Markers for Refining Fine Mapping

The Table shown in example four shows the marker or locus name on the far left of the table. The limiting factor for further refining the locus was the availability of markers and not the maize line recombinants. Thus additional taqman assays were developed for gathering genotypic information from the haploid induction region. The Table shows the SNPs and their map positions. Each of these markers identifies an allele. The desirable nucleotides for a haploid inducing allele in the RWK (haploid inducing line) are also listed. These markers can be utilized in a marker assisted breeding program to select for or against the haploid induction ability in germplasm.

TABLE 4

MARKER TABLE

| Marker or Locus Name | Chromosome | Map Position | RWK Allele |
|---|---|---|---|
| SM0262A | 1 | 45441103 | G/G |
| SM0390D | 1 | 45514003 | G/G |
| SM0657AQ | 1 | 56221199 | A/A |
| SM0103A | 1 | 60144794 | A/A |
| SM2317 | 1 | 60806574 | G/G |
| SM2318 | 1 | 60808690 | A/A |
| SM2315 | 1 | 60834691 | A/A |
| SM2322 | 1 | 61019467 | G/G |
| SM1994CQ | 1 | 61940683 | C/C |
| SM1994AQ | 1 | 61948232 | A/A |
| SM2014DQ | 1 | 62141179 | A/A |
| SM2014CQ | 1 | 62141297 | G/G |
| SM1208A | 1 | 62890212 | C/C |
| SM1208BQ | 1 | 62890343 | C/C |
| SM2332 | 1 | 62890343 | C/C |
| SM2331 | 1 | 62918261 | C/C |
| SM2542 | 1 | 65086371 | A/A |
| SM2543 | 1 | 65086379 | A/A |
| SM2547 | 1 | 65086882 | C/C |
| SM2548 | 1 | 65087687 | G/G |
| SM2359 | 1 | 65222457 | C/C |
| SM2366 | 1 | 65223245 | C/C |
| SM2333 | 1 | 65657736 | G/G |
| SM2338 | 1 | 66955942 | C/C |
| SM2340 | 1 | 67130654 | G/G |
| SM2339 | 1 | 67130683 | A/A |
| SM2356 | 1 | 67645465 | A/A |
| SM2357 | 1 | 67645486 | G/G |
| SM2361 | 1 | 67850657 | G/G |
| SM2363 | 1 | 67851018 | A/A |
| SM2587 | 1 | 68128675 | A/A |
| SM2589 | 1 | 68128928 | G/G |
| SM2593 | 1 | 68129217 | G/G |
| SM2594 | 1 | 68129237 | C/C |
| SM2602 | 1 | 68130522 | A/A |
| SM2607 | 1 | 68424731 | A/A |
| SM2608 | 1 | 68428500 | A/A |
| SM2365 | 1 | 68431623 | G/G |
| SM2362 | 1 | 68431768 | C/C |
| SM2712 | 1 | 68453157 | A/A |
| SM2709 | 1 | 68454360 | G/G |
| SM2706 | 1 | 68455010 | A/A |
| SM2710 | 1 | 68565361 | C/C |
| SM2707 | 1 | 68658060 | G/G |
| SM2550 | 1 | 68670604 | C/C |
| SM2551 | 1 | 68670713 | C/C |
| SM2708 | 1 | 68678452 | A/A |
| SM2610 | 1 | 69012158 | A/A |
| SM2613 | 1 | 69158347 | A/A |
| SM2552 | 1 | 69543214 | A/A |
| SM2553 | 1 | 69587711 | G/G |
| SM2554 | 1 | 69881293 | C/C |
| SM2556 | 1 | 69887955 | A/A |
| SM2557 | 1 | 69889226 | G/G |
| SM2558 | 1 | 70155695 | A/A |

TABLE 4-continued

MARKER TABLE

| Marker or Locus Name | Chromosome | Map Position | RWK Allele |
|---|---|---|---|
| SM2616 | 1 | 70158847 | A/A |
| SM2617 | 1 | 70159265 | A/A |
| SM2559 | 1 | 70162230 | A/A |
| SM2621 | 1 | 70164485 | A/A |
| SM2624 | 1 | 70213152 | A/A |
| SM2626 | 1 | 70244705 | A/A |
| SM2560 | 1 | 70251144 | A/A |
| SM2628 | 1 | 70347954 | A/A |
| SM2629 | 1 | 70512212 | G/G |
| SM2013BQ | 1 | 71020438 | C/C |
| SM2573 | 1 | 71066077 | C/C |
| SM2575 | 1 | 71541039 | A/A |
| SM2576 | 1 | 71590349 | A/A |
| SM2579 | 1 | 71794881 | G/G |
| SM2580 | 1 | 71794974 | C/C |
| SM2581 | 1 | 72013466 | A/A |
| SM2347 | 1 | 72233113 | G/G |
| SM2349 | 1 | 72233448 | G/G |
| SM2368 | 1 | 73246562 | G/G |
| SM2352 | 1 | 73379493 | A/A |
| SM2369 | 1 | 73380804 | C/C |
| SM2351 | 1 | 73635946 | G/G |
| SM2354 | 1 | 73966550 | G/G |
| SM2353 | 1 | 73966557 | G/G |
| SM2345 | 1 | 73967645 | A/A |
| SM0118A | 1 | 75203350 | G/G |
| SM0251A | 1 | 82575679 | G/G |
| SM0241C | 1 | 147159831 | A/A |
| SM0201B | 1 | 178008426 | A/A |
| SM1990AQ | 1 | 184012848 | G/G |
| SM0376B | 1 | 195332392 | G/G |

Example 5

New Interval Developed with Fine Mapping

As indicated in Example 4, the limiting factor for further refinement of the haploid induction QTL region was resolved with the development of additional markers for the haploid induction region on Chromosome 1. The recombinants were screened with these newly developed markers. The original haploid induction locus was reduced from a starting interval containing ~64 genes, which was then reduced its size to 17-25 genes. Further fine mapping resolved the region to 0.60 MB with 8 genes in the interval. The eight genes include two genes GRMZ2G471240, and GRMZ2G866758 which appear twice because expression data suggests alternative transcripts. Each of the genes are listed in the Table below and are identified by the public Gene ID with the transcript start and end identified. The new refined haploid induction locus is indicated in the new confidence level. With the data from a single recombinant, a subset of approximately 8 genes were identified to be highly likely to have impact on the haploid induction trait. These are indicated by the highlighted section of the third column from the left of the Haploid Interval Table below.

TABLE 5

Describing Haploid Induction QTL Interval

| New Confidence interval | Refined interval | Sequencing data analysis | gene_id |
|---|---|---|---|
| x | x | Appears to be missing from all three lines | GRMZM2G305400 |
| x | x | NIL and B73 gDNAs align in coding region. RWK/Stock 6 gDNAs are very similar. All protein coding sequences appear similar. | GRMZM2G082836 |
| x | x | NIL/B73 are identical. RWK differs at several bases and three AA residues. It also has a 21 base insert just downstream of the stop codon. Stock 6 data not so good at amino terminus, but suggests its similar to RWK at the carboxy terminus. | GRMZM2G382717 |
| x | x | Stock 6, RWK and NIL differ from B73 outside protein coding region. RWK and Stock 6 have 2 additional amino acids | GRMZM2G120587 |
| x | x | NIL and B73 are virtually identical. Stock 6 and RWK are identical and a frame shift results in 20 incorrect AA followed by a new, premature stop codon | GRMZM2G471240 |
|  | x |  | GRMZM2G471240 |
| x | x | Not present in Stock 6/RWK. NIL/B73 are virtually identical. Some evidence this is a transcribed gene. | GRMZM2G062320 |
|  | x | NIL and B73 are virtually identical. Stock 6 and RWK are identical. The pairs differ slightly at the protein level and outside the coding region. | GRMZM5G866758 |
|  | x |  | GRMZM5G866758 |
|  | x | NIL is 97-98% identical to B73; RWK/Stock 6 95-99% similar to B73. Adjacent to GRMZM5G866758 but transcribed from opposite strand. All 4 encode the same protein. | GRMZM2G003530 |

Example 6

Sequence Analysis of Inducer and Non-Inducer Genomes

The maize haploid induction locus was understood to be present in a 2.2 Mb QTL located on Chromosome 1. This QTL represents approximately 70% of the variation associated with the haploid induction trait, and is therefore required for haploid induction. To date, no one has identified the genetic element responsible for haploid induction. As indicated in the earlier examples the haploid induction QTL was fine-mapped to reduce its size to 0.60 Mb In order to further identify the genes in this Haploid Induction region, the genomes of two haploid inducer lines, Stock 6 and RWK, and an RWK-NIL line were sequenced. Stock 6 is a maize haploid inducer line which is available from the Maize Genetics Stock Center in Champaign Ill. RWK is a maize line which is a haploid inducer line available from the University of Hohenhiem in Germany. B73 is a stiff stalk maize line produced and is broadly available from many sources including the Iowa State University in Ames, IA Genomic DNA from the leaf tissue of RWK, RWK-NIL, and Stock 6, was prepared and fragmented to produce two short-insert paired end (SIPE) libraries and one long-insert paired end (LIPE) library. Sufficient DNA sequence data were generated for 50× coverage of each genome, as indicated in the table below. The raw data were trimmed and compiled into sequence contigs. B73 sequence data for the Haploid Induction QTL on Chromosome 1 was used as a scaffold to enrich and refine contigs corresponding to this region from each genome.

TABLE 6

Sequence Coverage

|  | SIPE data | | LIPE data | | total cov | % SIPE | % LIPE |
|---|---|---|---|---|---|---|---|
|  | total Mb | Coverage | total Mb | coverage | | | |
| Stock6 | 185,117 | 74.0 | 47,301 | 18.9 | 93.0 | 80% | 20% |
| NIL | 117,060 | 46.8 | 17,649 | 7.1 | 53.9 | 87% | 13% |
| RNK | 215,666 | 86.3 | 28,108 | 11.2 | 97.5 | 88% | 12% |

Total = total Mb of sequence data
coverage = average depth of sequence coverage (based on maize genome estimate of 2.5 Gb)
SIPE = short insert paired end library data (average insert size ~330 bp)
LIPE = long insert paired end library data (average insert size ~5000 bp)
Sequencing target was >= 50× coverage, >= 10% of data from LIPE reads The contigs were assembled and analyzed. The process produced ~300 contigs. These were then BLASTed against the 25 genes found within the HI interval. The candidate sequence from each line was annotated and compared. Expression was verified by cDNA/EST analysis, and the annotation was verified by cDNA/gDNA alignment. The differences between the lines were noted and distinguished. (see Tables in earlier examples.)

Example 7

Sequence Analysis of Inducer and Non-Inducer Genomes

The assembled Stock 6, RWK and NIL (RWK-NIL) sequence contigs were compared to corresponding B73 sequence data. Gene models for each candidate gene were confirmed with additional sequence data from public and proprietary databases. The sequence data for each gene in the reduced HI interval were compared.

TABLE 7

Structural Variants in Haploid Induction Interval

| Gene | structural variants? | # SNPs altering protein sequence | annotation |
|---|---|---|---|
| GRMZM2G120587 | No | 3 | Serine carboxypeptidase |
| GRMZM2G471240 | No | 4 | Patatin-like phospholipase |
| GRMZM2G062320 | Yes | 1 | Histidine phosphatase superfamily, Phosphoglycerate mutase family |
| AC213048.3 | No | 0 | pseudogene/hypothetical protein |
| GRMZM5G866758 | Yes | 2 | acetyl-CoA acetyltransferase, cytosolic 1 [Zea mays] |
| GRMZM2G003530 | Yes | 2 | Putative uncharacterized protein |
| GRMZM2G077991 | Yes | 2 | Ribosomal protein L37e |
| GRMZM2G077960 | No | 0 | Protein phosphatase 2C family protein |
| GRMZM2G077897 | No | 15 | Plant protein of unknown function, paramyosin, |
| GRMZM2G347583 | No | 2 | uncharacterized protein |
| GRMZM2G173030 | No | 0 | hypothetical protein |
| GRMZM2G031591 | Yes | 0 | hypothetical protein |
| GRMZM2G070462 | Yes | 0 | FHA domain-containing protein |
| GRMZM2G022061 | No | 5 | hypothetical protein LOC100279962 (LOC100279962 |
| GRMZM2G340286 | No | 4 | uncharacterized protein |
| GRMZM2G340279 | Yes | 8 | pentatricopeptide repeat-containing protein |
| GRMZM2G347808 | No | 4 | uncharacterized protein |

The experiment did not find DNA sequence evidence that GRMZM2G305400 is present in the Stock 6, RWK or Nil genomes.

The gene GRMZM2G062320 is encoding a phosphoglycerate mutase and is absent in RWK and Stock 6 but present in NIL and B73. This result will be tested by PCR. This gene product has expression in most plant tissues and stages of development. The gene product can be classified as a phosphoglycerate mutase and has sequence that places it in the histidine phosphatase superfamily.

We noted that other genes in the refined HI interval differ in sequence between the various genomes we examined. GRMZM2G471240 encodes a phospholipase that is exclusively expressed in meiotic anthers, and has a four nucleotide insertion resulting in 20 incorrect AA followed by a new, premature stop codon.

GRMZM2G120587 encodes a serine carboxypeptidase-like 51 (SCPL51) that is expressed in anthers and is a good candidate for a haploid induction because proteolysis has been shown to contribute towards centromere-specific localization of CENH3 proteins. The proteins encoded by RWK and Stock 6 have 2 additional amino acids.

GRMZM2G305400 encodes a cyclin and this gene was not present in the inducers or NIL, but it was present in B73.

GRMZM2G082836 gDNAs in Stock 6 and RWK are more similar to each other, and the GRMZM2G082836 gDNAs in NIL and B73 gene are more similar to each other. However the GRMZM2G082836 protein coding sequences of Stock 6, RWK, NIL and B73 are identical. This gene encodes a GTP-binding protein 1.

GRMZM2G382717 gDNAs in the NIL and B73 lines are identical. Sequence coverage for Stock 6 was not complete, but the available data align precisely to the RWK sequence data. RWK differs from NIL/B73 at several bases and at three amino acids, and there is an additional 21 base pair insertion in RWK downstream of the translation stop codon. This gene encodes a chaperone DnaJ-domain superfamily protein.

GRMZM5G866758 gDNAs from the B73 and NIL lines are virtually identical. GRMZM5G866758 gDNAs from the inducer lines, RWK and Stock 6, are identical. The data indicate some sequence differences between RWK/stock 6 and B73/NIL at the protein level and outside the protein coding sequence. This gene encodes an acetoacetyl-CoA thiolase 2.

Example 8

A Method to Knock Out GRMZM2G062320 Expression in Pollen

Any unique GRMZM2G062320 transcript sequence ranging from 200-500 contiguous bases can be used to make an RNAi molecule targeting this gene. Sequences comprising the double stranded RNA can separate by an intron, or other DNA strand that doesn't constrain formation of the GRMZM2G062320 double-strand RNA. Any number of constitutive promoters could be selected. A short list of some constitutive promoters include ZmUbi1, ZmUbi158, ZmUbi361, SbUbiCh3, SbUbiCh4. Pollen specific: Pollen-specific genes have been described for maize (Lopez I, Anthony, R. G., Maciver, S. K., Jaing, C.-J., Khan, S., Weeds, A. G., Hussey, P. J. (1996) Pollen specific expression of maize genes encoding actin depolymerizing factor-like proteins. Proc Natl Acad Sci USA 93:7415-7420.) Such information can be used to identify other maize pollen-specific genes and produce pollen-specific expression cassettes. An effective expression cassette to accomplish this in pollen is shown in FIG. 1. A general expression cassette design strategy is given in U.S. Pat. No. 8,129,58. Use of the NOS, AGS terminator components in the design is optional. The gene regulatory sequences are derived from the ZmABP2 gene (Lopez I, Anthony, R. G., Maciver, S. K., Jaing, C.-J., Khan, S., Weeds, A. G., Hussey, P. J. (1996) Pollen specific expression of maize genes encoding actin depolymerizing factor-like proteins. Proc Natl Acad Sci USA 93:7415-7420.).

Example 9

Example Demonstrating Conservation of GRMZM2G062320 Protein Sequence in Maize

Syngenta's Maize Solexa Association panel is a collection of RNA-seq data derived from 790 lines. Lines in this collection were chosen based on their phenotypic and genotypic diversity from a larger collection of maize germplasm. Seedling leaf tissue was used to generate the data. The largest open reading frame for each cDNA was translated to the encoded protein for each line. The proteins were then compared to establish diversity across all lines. This evidence shows that there are five GRMZM2G062320 variants in this collection. Sequence analysis of these 790 diverse maize lines showed that version A, SEQ ID NO: 5 is present in 784 lines, version B, SEQ ID NO: 2 is present in 3 lines and versions C SEQ ID NO: 6, D SEQ ID NO: 7, and E SEQ ID NO: 8 are present in one line each. The protein sequences are derived from RNA-seq data. The alignment shown in FIG. 1 show these proteins differ at four positions. The evidence suggests the GRMZM2G062320 protein is highly conserved.

```
>GRMZM2G062320-A
                                            SEQ ID NO: 5
MAGAISHHALAFSQSHWCSAKNSRFGKRTGNARLVYLKGRCGSGSRKLGL

MWASSSQSSVMEPTHLPSDGNSSHTPKKSSESALILIWHGESLWNEKNLF

TGCIDVPLTPKGVEEAIEAGKRICNIPIDVIYTSSLICAQMTAMLAMMQH

RRKKIPVITHNESEQAHRWSQIYSEETMKQSIPVITAWQLNERMYGELQG

LNKQETVDRFGKEQVHEWHRSYDIPPPNGESLEKCAERAVAYFKDQIIPQ

LVAGKHVMVAAHGNSLRSIIMHLDKLTSQKVISLELSTGIPMLYIFKEGK

FIRRGTPVGPSEASVYAYTRTKRFAEHITFQNKLA

>GRMZM2G062320-B
                                            SEQ ID NO: 2
MAGAISHHALAFSQSHWCSAKNSRFGKRTGNARLVYLKGRCGSGSRKLGL

MWASSSQSSVMEPTHLPSDGNSSHTPKKSSESALILIWHGESLWNEKNLF

PGCIDVPLTPKGVEEAIEAGKRICNIPIDVIYTSSLICAQMTAMLAMMQH

RRKKILVITHNESEQAHRWSQIYSEETMKQSIPVITAWQLNERMYGELQG

LNKQETVDRFGKEQVHEWRRSYDIPPPNGESLEKCAERAVAYFKDQIIPQ

LVAGKHVMVAAHGNSLRSIIMHLDKLTSQKVISLELSTGIPMLYIFKEGK

FIRRGTPVGPSEASVYAYTRTKRFAEHITFQNKLA

>GRMZM2G062320-C
                                            SEQ ID NO: 6
MAGAISHHALAFSQSHWCSAKNSRFGKRTGNARLVYLKGRCGSGSRKLGL

MWASSSQSSVMEPTHLPSDGNSSHTPKKSSESALILIWHGESLWNEKNLF
```

-continued

PGCIDVPLTPKGVEEAIEAGKRICNIPIDVIYTSSLICAQMTAMLAMMQH

RRKKIPVITHNESEQAHRWSQIYSEETMKQSIPVITAWQLNERMYGELQG

LNKQETVDRFGKEQVHEWHRSYDIPPPNGESLEKCAERAVAYFKDQIIPQ

LVAGKHVMVAAHGNSLRSIIMHLDKLTSQKVISLELSTGIPMLYIFKEGK

FIRRGTPVGPSEASVYAYTRTKRFAEHITFQNKLA

>GRMZM2G062320-D
SEQ ID NO: 7
MAGAISHHALAFSQSHWCSAKNSRFGKRTGNARLVYLKGRCGSGSRKLGL

MWASSSQSSVMEPTHLPSDGNSSHTPKKSSESALILIWHGESLWNEKNLF

TGCIDVPLTPKGVEEAIEAGKRICNIPIDVIYTSSLICAQMTSMLAMMQH

RRKKIPVITHNESEQAHRWSQIYSEETMKQSIPVITAWQLNERMYGELQG

LNKQETVDRFGKEQVHEWHRSYDIPPPNGESLEKCAERAVAYFKDQIIPQ

LVAGKHVMVAAHGNSLRSIIMHLDKLTSQKVISLELSTGIPMLYIFKEGK

FIRRGTPVGPSEASVYAYTRTKRFAEHITFQNKLA

>GRMZM2G062320-E
SEQ ID NO: 8
MAGAISHHALAFSQSHWCSAKNSRFGKRTGNARLVYLKGRCGSGSRKLGL

MWASSSQSSVMEPTHLPSDGNSSHTPKKSSESALILIWHGESLWNEKNLF

TGCIDVPLTPKGVEEAIEAGKRICNIPIDVIYTSSLICAQMTSMLAMMQH

RRKKIPVITHNESEQAHRWSQIYSEETMKQSIPVITAWQLNERMYGELQG

LNKQETVDRFGKEQVHEWRRSYDIPPPNGESLEKCAERAVAYFKDQIIPQ

LVAGKHVMVAAHGNSLRSIIMHLDKLTSQKVISLELSTGIPMLYIFKEGK

FIRRGTPVGPSEASVYAYTRTKRFAEHITFQNKLA

Example 10

PCR Experiments to Determine the Presence or Absence of GRMZM2G062320 in the Haploid Inducer Lines These pairs worked as expected on NIL, RWK, and Stock6 DNA: NIL gDNA only amplified the NIL primer pair. RWK and Stock6 gDNA only amplified the RWK/Stock6 primer pair, which specifically detects the frame-shift allele. The PCR products were sequenced and the sequences were identical to that from whole genome sequencing. The primer pairs are "nil.F1/R1" and "rwk.F1/R1".
Three PCR reactions spanning all but the first two exons of the gene model amplified in RWK and Stock6, and the amplicons had the correct size PCR gel band. These bands were excised from the gel, sub-cloned and sequenced, and were found to be nearly identical in sequence to the B73 and NIL amplicons, except for a few single nucleotide polymorphisms (SNPs). These SNPs may represent normal genetic drift because none of them caused non-conservative amino acid substitutions. The 5' end of the gene model could not be detected by PCR in RWK, Stock6, or NIL DNA samples. After multiple rounds of PCR and primer redesign, the 5' end was never amplified or cloned in any of the lines. Overall, this data contradicts the genome assemblies, suggesting that at least part of the gene model exists in RWK and Stock6 inducers.
One primer pair, designed to amplify a ~400 bp amplicon spanning exons 6-8, not only amplified in all lines tested, but the DNA sequence also matched B73 with 100% nucleotide identity. This primer pair was used to query a panel of high, low, and non-inducer maize plants. The high inducers all give greater than 7% haploid embryos upon outcrossing through the male (>7% haploid induction rate (HIR)). The low inducers have a HIR between 1 and 3%, and the non-inducers have a HIR of <0.1%. All of the high and low inducer lines were derived from the original Stock6 line, and thus it is assumed that the lesion responsible for haploid induction should be present in all high and low inducers, and absent in non-inducers.
When the exon 6-8 PCR primers were tested on these DNA samples, a band of the correct size and sequence was found in 9/9 non-inducers, 8/12 high inducers, and 6/7 low inducers. No band was present in 4/12 high inducers and 1/7 low inducers (Table 1). This indicates that, contrary to the sequencing data, this gene does exist in RWK and Stock6, but in various other induction lines, there may be presence/absence variation but it does not correlate with induction capacity. This makes it difficult to explain how GRMZM2G062320 is responsible for haploid induction.

TABLE 8

| GRMZM2G062320 PCR test for presence of amplicon exon 6-8 | Induction Rate | Band present? |
|---|---|---|
| Controls: | | |
| Stock 6 (low) | 2.50% | + |
| RWK (high) | 12% | + |
| RWK-NIL (non) | <1% | + |
| High Inducers: | | |
| ZMS | 7% | − |
| Z19-PR | 7% | − |
| RWS-Z86 | 10% | + |
| K13 | 9% | + |
| (ID3002/Z22)B > 29-5 > 2-5-1-B- Z-19-//AF4031PR//Z-19-)1-1-2-3-1-3-B- | 7% | − |
| | 9.5% | + |
| ZR86 | 12% | + |
| ZR53 | 12% | − |
| ZR75 | 13% | + |
| (Z21/RWS)B(GS)-75-1-2-3-B- | ~8% | + |
| AX5707 inducer-good | ~9% | + |
| Poor Inducers: | | |
| Stock6 R1-nj | 2.5% | + |
| (Z21/RWS//[RWS]B$)33-5- | <2% | + |
| (K-13-/(ZMS/SEW-PR)B > 2 > B-9//K-13-)2-4-1- | <2% | + |
| (K-13-/(ZMS/SEW-PR)B > 2 > B-9//K-13-)6-1-2- | <2% | + |
| (ZMS/SEW-PR)B > 2 > B-7-2-1-2- | 2% | − |
| AX5707 inducer-low | ~3% | + |
| Non-inducers: | | |
| Stock6 R1-nj B1Pl1 | <0.1% | + |
| (Z-21-/AF4031PR//Z-21-1-B-)1-1-1-1-B- | <0.1% | + |
| FF6096 | <0.1% | + |
| ID5829 | <0.1% | + |
| X05744 | <0.1% | + |
| ID3002 | <0.1% | + |
| AF4031PR | <0.1% | + |
| AX5707 | <0.1% | + |

Example 11

PCR Experiments to Determine the Presence or Absence of GRMZM2G471240 in the Haploid Inducer Lines In order to develop a PCR test that would distinguish between RWK/Stock6 and NIL haplotypes, two primer pairs were designed: one pair should amplify the RWK/Stock6 frame-shift allele, while the other should amplify the B73/NIL allele.

For STOCK6/RWK allele (mutant, frameshift allele):

```
rwk.F1
TACGCCGTGCGCTAACATA rwk.R1
GTACCTCGCTCCCTGTCTCC
```

SIZE: 822 bp
FOR B73/RWK-NIL

```
nil.F1
GTACGCCGTGCGCTAACA nil.R1
TCGTACCTCCCTGTCTCCAC
```

SIZE: 821
Use: In a PCR reaction, these would be used at 500 nMol final concentration. The reaction may also contain:
1×PCR reaction buffer
200 uM of dNTPs (dATP, dCTP, dGTP, and dTTP)
<250 ng of genomic DNA
deionized water
Taq enzyme (1 unit—many different types available—usually 0.2 uL or 0.5 uL depending on the units/uL
magnesium chloride or magnesium sulfate (1 mM)
Reaction volume: 25 or 50 uL
recommended reaction:
  1. 95 degrees C. 3'
  2. 95 degrees C. 30" (denature)
  3. 62 degrees C. 30" (anneal)
  4. 72 degrees C. 1' (extend)
  5. Repeat steps 2-4, 35 times
  6. 72 degrees C., 10" (final extension)
  7. 4 degrees C., forever These pairs worked as expected on NIL, RWK, and Stock6 DNA, NIL gDNA only amplified the NIL primer pair. RWK and Stock6 gDNA only amplified the RWK/Stock6 primer pair, which specifically detects the frameshift allele. The PCR products were sequenced and the sequences were identical to that from whole genome sequencing. SNPs that were identified in the whole genome sequencing were confirmed in the PCR products (data not shown). The primer pairs are "nil.F1/R1" and "rwk.F1/R1".

Example 12

A Method to Knock Out GRMZM2G471240 Expression

Any unique GRMZM2G471240 transcript sequence ranging from 200-1000 contiguous bases can be used to make an RNAi molecule targeting this gene. Sequences comprising the double stranded RNA can separate by an intron, or other DNA strand that doesn't constrain formation of the GRMZM2G471240 double-strand RNA. Any number of constitutive promoters could be selected. A short list of some constitutive promoters include ZmUbi1, ZmUbi158, ZmUbi361, SbUbiCh3, SbUbiCh4. Pollen specific: Pollen-specific genes have been described for maize (Lopez I, Anthony, R. G., Maciver, S. K., Jaing, C.-J., Khan, S., Weeds, A. G., Hussey, P. J. (1996) Pollen specific expression of maize genes encoding actin depolymerizing factor-like proteins. Proc Natl Acad Sci USA 93:7415-7420.) Such information can be used to identify other maize pollen-specific genes and produce pollen-specific expression cassettes. An effective expression cassette to accomplish this in pollen is shown in FIG. 1. A general expression cassette design strategy is given in U.S. Pat. No. 8,129,58. Use of the NOS, AGS terminator components in the design is optional. The gene regulatory sequences are derived from the ZmABP2 gene (Lopez I, Anthony, R. G., Maciver, S. K., Jaing, C.-J., Khan, S., Weeds, A. G., Hussey, P. J. (1996) Pollen specific expression of maize genes encoding actin depolymerizing factor-like proteins. Proc Natl Acad Sci USA 93:7415-7420.). Expression constructs have been built comprising. The promoter of GRMZM2G471240 as in SEQ ID NO: 58 operably linked to the hairpin construct in SEQ ID NO: 60 operably linked to the terminator of SEQ ID NO:59. Another construct was made with The promoter of GRMZM2G471240 as in SEQ ID NO: 58 operably linked to the hairpin construct in SEQ ID NO: 61 operably linked to the terminator of SEQ ID NO:59.

Example 13

Generation of Transgenic Maize Plants

Transformation of immature maize embryos is performed essentially as described in Negrotto et al., Plant Cell Reports 19:798-803 (2000). Various media constituents described therein can be substituted.
*Agrobacterium* strain LBA4404 (Invitrogen) containing the plant transformation plasmid is grown on YEP (yeast extract (5 g/L), peptone (10 g/L), NaCl (5 g/L), 15 g/l agar, pH 6.8) solid medium for 2 to 4 days at 28° C. Approximately 0.8×109 Agrobacteria are suspended in LS-inf media supplemented with 100 μM acetosyringone (As) (LSAs medium) (Negrotto et al., Plant Cell Rep 19:798-803 (2000)). Bacteria are pre-induced in this medium for 30-60 minutes.
Immature embryos from maize line, A188, or other suitable maize genotypes are excised from 8-12 day old ears into liquid LS-inf+100 μM As (LSAs). Embryos are vortexed for 5 seconds and rinsed once with fresh infection medium. Infection media is removed and *Agrobacterium* solution is then added and embryos are vortexed for 30 seconds and allowed to settle with the bacteria for 5 minutes. The embryos are then transferred scutellum side up to LSAs medium and cultured in the dark for two to three days. Subsequently, between 20 and 25 embryos per petri plate are transferred to LSDc medium supplemented with cefotaxime (250 mg/1) and silver nitrate (1.6 mg/1) (Negrotto et al., Plant Cell Rep 19:798-803 (2000)) and cultured in the dark for 28° C. for 10 days. Immature embryos producing embryogenic callus are transferred to LSD1M0.5S medium (LSDc with 0.5 mg/l 2,4-D instead of Dicamba, 10 g/l mannose, 5 g/l sucrose and no silver nitrate). The cultures are selected on this medium for 6 weeks with a subculture step at 3 weeks. Surviving calli are transferred either to LSD1M0.5S medium to be bulked-up or to Reg1 medium (as described in Negrotto et al., Plant Cell Rep 19:798-803 (2000)). Calli transformed with an *agrobacterium* binary vector carrying the RNAi expression cassette comprising or SEQ ID NO: 61 are surviving selection indicating successful transformation. See FIG. 1. An *agrobacterium* binary vector carrying the RNAi expression cassette comprising or SEQ ID NO: 60 will be transformed into maize. Following culturing in the light (16 hour light/8 hour dark regiment), green tissues will be transferred to Reg2 medium without growth regulators (as described in Negrotto et al., Plant Cell Rep 19:798-803 (2000)) and incubated for 1-2 weeks. Plantlets will be transferred to Magenta GA-7 boxes (Magenta Corp, Chicago Ill.) containing Reg3 medium (as described in Negrotto et al. (2000)) and grown in the light. Plants that are PCR positive for PMI and negative for Spectinomycin will be transferred to soil and grown in the greenhouse.

Example 14

Haploid Induction

T0 transgenic plants expressing an RNAi construct which silences GRMZM2G471240 will be tested for haploid induction capacity. The pollen from each plant is to be crossed onto an ear to induce fertilization, and the resulting progeny of the cross subjected to ploidy analysis. Ploidy analysis can be defined in this case as any experimental test where the ploidy level of an individual plant is determined. In crosses between two non-inducing lines, the resulting progeny should be almost exclusively diploid, or 2N. However, if a haploid induction line is the male parent, the resulting progeny will be a mixed population of haploids (1N), diploids (2N), aneuploids (somewhere between 1N and 2N), and chimeras (containing tissues with mixed ploidy). The determination of haploid induction capacity can be made binary by setting a cutoff value for the haploid induction rate, which is defined as the number of haploid embryos over the total number of viable embryos. The rate should be at least greater than 0.5%.

Example 15. Identifying the Frameshift Mutation in PLA

The present invention identifies a series of independent human-induced mutations found in at least one patatin-like phospholipase AIIα (pPLAIIα) gene of maize; maize plants having these mutations in at least one of their PLA genes; and a method of creating and identifying similar and/or additional mutations in the PLA gene by screening pooled and/or individual rice and maize plants. The rice and maize plants of the present invention induce haploidy as a result of non-transgenic mutations in at least one of their PLA genes.

More specifically, the present invention produces new maize haploid inducing lines. A number of known haploid-inducing maize lines exist including but not limited to: Stock 6, MHI (Moldovian Haploid Inducer), indeterminate gametophyte ("ig") mutation, KEMS, ZEM, ZMS, KMS, RWS, and RWK. The present invention relates to a method of identifying, and/or selecting germplasm which can or cannot induce haploids. The present invention also relates to increasing and further development of the selected haploid inducing germplasm. The invention further relates to a method of improving haploid inducing germplasm to increase the induction of haploids on the seed producing parent.

The initial step in the production of haploid seeds from a hybrid or segregating maternal parent plant derives from the pollination with pollen from a haploid inducer onto the ear from a seed producing plant. A result of this hybridization process is the production of diploid and maternal haploid (1n) kernels. The induced haploid (1n) kernels are often distinguished from the diploid seed by the use of color markers which indicate embryo ploidy. The diploid seeds are generally discarded, while haploid kernels or embryos are often subjected to chromosome doubling processes to produce doubled haploid plants. More specifically, the haploid genetic material is treated with one or more mitotic arrest agents to allow the haploid (1n) chromosome complement in one or more cells to produce homolog pairs. After the chemical treatment procedure, the chromosome doubling chemical(s) are removed. The now-doubled haploid maize is allowed to mature and the resulting doubled haploid seeds when planted will produce homozygous plants (also called inbred plant or lines). These inbred lines are the materials that breeders utilize to pursue their hybrid development programs.

Figure 2:
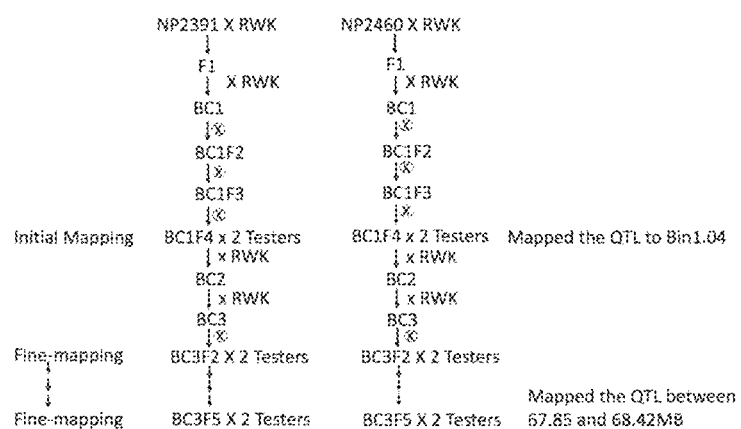
FIG. 2 is a mapping scheme used to map the haploid induction trait in RWK.

The locus for the haploid induction trait was fine mapped. Although a major QTL on chromosome 1 responsible for haploid induction has been mapped and published, Dong et al. Theor. Appl. Genet (2013) 126: 1713-1720, the exact gene/genetic element responsible for the induction process has not been identified until now. To clarify the developmental genetics underlying haploid induction, the Stock 6 derivative RWK (~13% HIR) was obtained from the University of Hohenheim in 2006, crossed to inbreds NP2460 and NP2391, and subsequently backcrossed to RWK to generate mapping populations. See FIG. 2.

Elevated HIR in both populations co-segregated with marker SM020SDQ in bin 1.04, consistent with recent reports on a QTL called qhir1. See Prigge, et al., New Insights into the Genetics of in Vivo Induction of Maternal Haploids, the Backbone of Doubled Haploid Technology in Maize, GENETICS (2012) 190:781-793 (discussing major QTL for HI in Bin 1.04 [qhir1] and minor QTLs for HI in Bins 3.02 [qhir2], 3.06 [qhir3], 4.03 [qhir4], 5.01 [qhir5], 5.04 [qhir6], 7.01 [qhir7], and 9.01 [qhir8]); Liu, et al., Fine mapping of qhir8 affecting in vivo haploid induction in maize, THEOR. APPL. GENET. (2015) 128:2507-2515 (fine mapping thirty-five genes to qhir8); Hu, et al., The Genetic Basis of Haploid Induction in Maize Identified with a Novel Genome-Wide Association Method, GENETICS (2016) 202:1267-1276 (asserting that qhir1 is two QTLs: qhir11 and qhir12, and fine mapping qhir6 to a 1.1 Mb region). We did several rounds of fine mapping and narrowed the QTL to an approximately 0.57 Mb region between 67.85 Mb and 68.42 Mb that lies within qhir11. This region has seven annotated genes.

Using the Illumina HiSeq2000, we sequenced RWK, Stock 6, and a BC3F5 non-inducer "RWK-NIL" that is near-isogenic to RWK but has NP2391 haplotypes in the qhir11 interval. By comparing inducer and non-inducer germplasm, it was determined that a four nucleotide insertion present in haploid inducers which shifts the frame for amino acid coding of GRMZM2G471240 is not present in non-inducer germplasm. Therefore, the present invention has identified a gene with a frameshift mutation in inducer germplasm as being responsible for maize haploid induction. The candidate gene corresponding to gene model GRMZM2G471240 encodes patatin-like phospholipase AIIα (pPLAIIα), which we have renamed MATRILINEAL (MTL) to represent the wildtype allele and the frameshift allele is referred to as matrilineal (mtl).

DNA sequence was generated for each candidate gene from the two inducer lines (Stock6 and RWK) and one non-inducer line (RWK-NIL). In addition, the public B73 genome data was used as a second non-inducer line. Gene model information was compared to EST/cDNA data to confirm the structure of each gene. The annotated sequence data were compared to catalog differences between the four alleles of each gene.

The sequence comparisons revealed that B73 and RWK-NIL alleles were similar to each other, and RWK and Stock 6 alleles were similar to each other. Most sequence differences were single nucleotide polymorphisms that do not alter protein coding sequence. There were some insertions and some deletions, most of which are in non-protein coding sequence.

Figure 3:
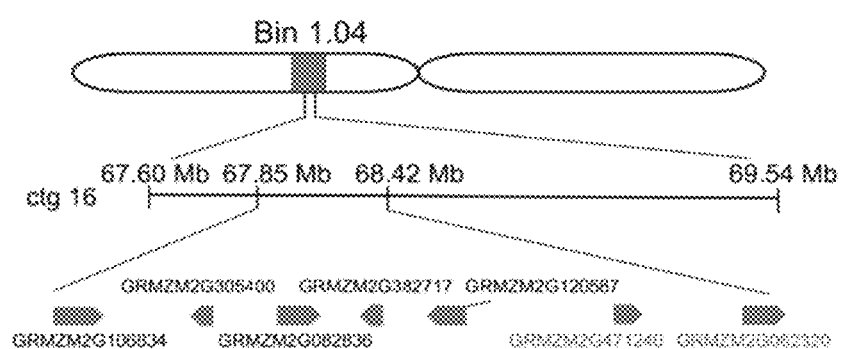
FIG. 3 shows fine mapping narrowed the major QTL to a very small interval in bin 1.04, between 67.85 Mb and 68.42 Mb. This region has seven annotated genes. We sequenced and assembled the genes in this interval in several lines. The two genes with the most dramatic mutations in the haploid inducer lines are shown on the bottom right (GRMZM2G471240 and GRMZM2G062320).

Having completed fine mapping of the haploid inducer trait to an interval containing only seven genes, we focused on those in the sequence assembly and analysis. The sequences for the seven genes were nearly identical between B73 and RWK-NIL, but RWK and Stock 6 lacked GRMZM2G062320, a PHOSPHOGLYCERATE MUTASE (PGM), and had a 4 basepair ("bp") insertion in the fourth exon of GRMZM2G471240, a PATATIN-LIKE PHOSPHOLIPASE AIIα (pPLAIIα) (FIG. 3). We found that RWK and Stock6 both have the same 4 bp insertion in the fourth exon of pPLAIIα, and that this gene is specifically expressed in pollen (see maizegdb.org/gene_center/gene?id=GRMZM2G471240 incorporated herein by reference). The unmutated GRMZM2G471240 is represented by SEQ ID NO: 68. GRMZM2G471240, comprising the 4 bp insertion in the fourth exon, is represented by SEQ ID NO: 70.

Most of the haploids that were identified were found using a taqman marker test. This marker test takes advantage of a difference in the pPLAIIα gene between RWK×NP2222. In crosses where we use RWK as the female, and NP2222 as the male, the RWK parent is homozygous for the mtl allele, while NP2222 is homozygous for the MTL allele. Diploid progeny are MTL/mtl and haploid gynogenetic haploid progeny are mtl/0. Therefore when this test is done the taqman results show 1 copy of the mtl allele and one copy of MTL allele in the diploid progeny, and 1 copy of the mtl but no copies of MTL in the haploid progeny. When this type of cross is performed, ears are harvested between 12-21 days following pollination, the embryos are extracted and a small sample of the embryos are taken for taqman marker analysis. Alternatively the embryos are plated on solid media and germinated in the dark so that a larger sample of the extended shoot or root can be taken between 2-10 days later for marker analysis. At the same time some of the tissue is saved for ploidy analysis. In this latter case after the molecular test is used, the larger samples of the haploids can be run on a CyFlow Space ploidy analyzer and confirmed as haploids. In most cases this results in the positive identification of haploids. In a few rarer cases this results in the overturning of the false positive marker results and correction of the call as a diploid.

Another way we test for haploids is via dominant marker assay. In this case, an X26 male line is used. This line is homozygous for a marker that acts in a dominant fashion. In such a cross any line can be used as a female as long as it doesn't have a marker or any genes or alleles that work to inhibit the marker phenotype. The X26 line is a non-inducer and is homozygous for MTL. Using such a line, the progeny are dissected between 12-21 days after pollination and evaluated for the presence of the marker, or they are examined directly on the ear, or the dried kernels are harvested and evaluated for the presence of the marker. Diploid progeny show the marker phenotype because they have a single copy of the marker gene from the X26 male parent, whereas gynogenic haploid progeny do not show the marker phenotype. The penetrance of the marker and the spontaneous haploid induction rate of X26 was tested in numerous control crosses. Using this system we screen for haploids and then test them on the ploidy analyzer to confirm that they are truly haploids.

We developed PCR tests to specifically detect the "wild-type" and "mutant" alleles for screening of nineteen Stock 6-derived inducers, including NP2222-Haploid Inducer (NP2222-HI), a BC3 introgression of RWK into Syngenta's standard transformable inbred line NP2222. We also screened nine non-inducer control lines.

To develop a PCR test that would distinguish between RWK/Stock6 and RWK-NIL haplotypes, two primer pairs were designed: one pair should amplify the RWK/Stock6 frame-shift allele, while the other should amplify the B73/RWK-NIL allele. These pairs worked as expected on RWK-NIL, RWK, and Stock6 DNA: RWK-NIL gDNA only amplified the RWK-NIL primer pair. RWK and Stock6 gDNA only amplified the RWK/Stock6 primer pair, which specifically detects the frame-shift allele. The PCR products were sequenced and the sequences were identical to that from whole genome sequencing. SNPs that were identified in the whole genome sequencing were confirmed in the PCR products. Below, in FIG. 3, the DNA used in each reaction is in capital letters. The primers are "nil.F1/R1" and "rwk.F1/R1."

```
GRMZM2G471240_nil.F1:
                                    (SEQ ID NO: 66)
GTACGCCGTGCGCTAACA.

GRMZM2G471240_nil.R1:
                                    (SEQ ID NO: 67)
TCGTACCTCCCTGTCTCCAC.

GRMZM2G471240_rwk.F1:
                                    (SEQ ID NO: 64)
TACGCCGTGCGCTAACATA.

GRMZM2G471240_rwk.R1:
                                    (SEQ ID NO: 65)
GTACCTCGCTCCCTGTCTCC.
```

The "rwk.F1/R1" and "nil.F1/R1" primer pairs were used to genotype the panel of high, low, and non-inducers. We found that all 19 haploid inducer lines had the 4 bp insertion, including Stock6 (3% haploid induction rate ["HIR"]), RWK (line derived from the University of Honheim stocks, 10-15% HIR), RWS, and Z22, among others. In contrast, the wild-type allele was found in all nine non-haploid inducer lines (average HIR of 0.1%). The data indicates that homozygosity for the frame-shift allele correlates with induction capacity: 12/12 high and 7/7 low inducers amplified the frame-shift assay, but not the wild type assay, while 9/9 non-inducers amplified the wild type but not frame-shift assay. This indicates that induction capacity correlates with the GRMZM2G471240 mutation, and that pPLAIIα underlies qhir11 and is the primary mutation responsible for haploid induction in these lines.

TABLE 9

GRMZM2G471240 PCR test results.

|  | Induction Rate | RWK amplicon | RWK-NIL amplicon |
|---|---|---|---|
| Controls: |  |  |  |
| Stock 6 (low inducer) | 2.50% | + | − |
| RWK (high inducer) | 12% | + | − |
| RWK-NIL (non-inducer) | <1% | − | + |
| Good Inducers: |  |  |  |
| ZMS | 7% | + | − |
| Z19-PR | 7% | + | − |
| RWS-Z86 | 10% | + | − |
| K13 | 9% | + | − |

TABLE 9-continued

GRMZM2G471240 PCR test results.

| | Induction Rate | RWK amplicon | RWK-NIL amplicon |
|---|---|---|---|
| (ID3002/Z22)B > 29-5 > 2-5-1-B-Z-19-//AF4031PR//Z-19-)1-1-2-3-1-3-B- | 7%<br>9.50% | +<br>+ | −<br>− |
| ZR86 | 12% | + | − |
| ZR53 | 12% | + | − |
| ZR75 | 13% | + | − |
| (Z21/RWS)B(GS)-75-1-2-3-B- | ~8% | + | − |
| NP2222 inducer-good | ~9% | + | − |
| Poor Inducers: | | | |
| Stock6 R1-nj | 2.50% | + | − |
| (Z21/RWS//[RWS]B$)33-5-(K-13-/(ZMS/SEW-PR)B > 2 > B-9//K-13-)2-4-1- | <2%<br><2% | +<br>+ | −<br>− |
| (K-13-/(ZMS/SEW-PR)B > 2 > B-9//K-13-)6-1-2- | <2% | + | − |
| (ZMS/SEW-PR)B > 2 > B-7-2-1-2- | <2% | + | − |
| NP2222 inducer-low | ~3% | + | − |
| Non-inducer Lines and Donors: | | | |
| Stock6 R1-nj B1Pl1 | <0.1% | − | + |
| (Z-21-/AF4031PR//Z-21-1-B-)1-1-1-1-B- | <0.1% | − | + |
| FF6096 | <0.1% | − | + |
| ID5829 | <0.1% | − | + |
| X05744 | <0.1% | − | + |
| ID3002 | <0.1% | − | + |
| AF4031PR | <0.1% | − | + |
| NP2222 | <0.1% | − | + |

We also identified a number of single nucleotide polymorphisms ("SNPs") between the frame-shift allele and that of RWK-NIL. For many of these SNPs, the STOCK6 and RWK sequences agreed with other inbreds we have sequenced, and thus likely represent natural variation. Indeed most of these SNPs did not alter the amino acid sequence and thus likely do not contribute to the haploid induction phenotype. Two SNPs did result in amino acid changes (H107Y; K232N) and these are not highly conservative changes, so they may have a small contribution to the phenotype, but mostly like they do not impact the phenotype because the frame-shift causes a loss of function.

We renamed pPLAIIα "MATRILINEAL" (MTL; i.e., SEQ ID NO: 68) and the native 4 bp insertion allele "matrilineal" (mtl; of which the cDNA is SEQ ID NO: 70). According to the predicted protein sequence, the 4 bp insertion causes a shift in the open reading frame of the protein at amino acid ("AA") 352 out of 401. The frame-shift leads to a premature stop codon.

After finding the frame-shift knock-out mutation we directly tested the effect it had on haploid induction by complementing a haploid inducer line with a wild-type pPLAIIα transgene. Heterologous complementation of NP2222-HI (10.2% HIR) with a wild-type copy of MATRILINEAL virtually eliminated haploid induction and kernel abortion. Compared to controls the HIR decreased 50-fold, from 10% to 0.23%. It also decreases the embryo abortion rate to 0.65%. Full length functional reporter lines were also made using transgenic fusions of the wild type MTL gene to GFP as well as the mutant allele mtl to GFP, in order to both visualize subcellular localization of wild-type MTL, but also to see if the mutant version of the protein localizes correctly or is produced at all. These lines also served as additional material to test for complementation. Haploid inducer material (NP2222-HI) that was homozygous for the MTL-GFP transgene also did not exhibit the haploid inducer phenotype. The induction rate of NP2222-HI falls to 0.60% when it is homozygous for MTL-GFP. Additionally, the MTL-GFP transgene also knocked down embryo abortion to 4.86%. Finally we tested whether the mutant mtl allele fused to GFP complements the haploid induction phenotype, and it does not. Haploid induction and embryo abortion rates were very similar in NP2222-HI compared to NP2222-HI that was homozygous for the mutant fusion transgene mtl-GFP. See Table 10. This represents conclusive evidence that the MATRILINEAL frame-shift is responsible and required for haploid induction. To apply this knowledge, we demonstrate that mutating or modulating the expression of pPLAIIα in a wild type line leads to the creation of new haploid induction lines.

TABLE 10

Reproductive characteristics of haploid inducer, complementation and edited lines. This table shows the haploid induction and kernel abortion rates of inducer lines in the NP2222 background. The number testcrosses is listed first ("ears") and then the kernel and embryo statistics are listed. Embryo abortion and haploid induction generally comes together on the same ear. That is why the embryo abortion rate is so high in an ear crossed by the NP2222-HI male, which has a 10.17% haploid induction rate (HIR). Both the WT transgenes, including one without GFP and one fused to GFP, complemented the haploid induction phenotype. Meanwhile, the mutant mtl fused to GFP did not complement.

| Complementation Assays | | Kernel characteristics | | | Embryos tested | | | |
|---|---|---|---|---|---|---|---|---|
| Male parent | ears | viable | aborted | % aborted | embryos | haploids | diploids | HIR |
| NP2222-HI | 4 | 548 | 498 | 47.61% | 531 | 54 | 477 | 10.17% |
| NP2222-HI + MTL/MTL | 17 | 4403 | 29 | 0.65% | 4321 | 11 | 4310 | 0.25% |
| NP2222-HI + mtl-GFP/mtl-GFP | 3 | 371 | 298 | 44.54% | 360 | 34 | 326 | 9.44% |
| NP2222-HI + MTL-GFP/MTL-GFP | 3 | 1019 | 52 | 4.86% | 836 | 5 | 831 | 0.60% |

Several mtl-like alleles were generated in the inbred NP2222 by introducing small deletions in MTL close to the 4 bp insertion site in mtl, using transcription activator-like effector nucleases (TALEN) (Boch, J. et al., Breaking the code of DNA binding specificity of TAL-type III effectors, Science 326:1509-1512 (2009), incorporated herein by reference). Several mutant events were self-pollinated and T1 plants lacking the TALEN T-DNA insert but homozygous for small deletions in MTL were outcrossed onto NP2222. Edited lines homozygous for frame-shift deletions in MTL (hereafter called MTL's) exhibited an HIR of 4.0-12.5% (average 6.65%) (Table 11). The ploidy status of 118/127 putative haploids was confirmed by Flow Cytometry, and phenotypic evaluations indicated these plants were haploids. These results prove that a frame-shift in MTL is sufficient to induce high rates of haploid induction. Other contributors to the phenotype have been mapped including the neighboring qhir12 (see Liu, 2016)), which may account for the difference between the HIR of $MTL^{TAL-FS}$ and NP2222-HI. It reasonable to infer that seed set, HIR and kernel abortion rates are set through mtl by paternal and maternal genotype-specific interactions.

TABLE 11

Reproductive characteristics of MTL edited lines (generally referred to as $MTL^{TAL-FS}$ lines). This table shows the haploid induction and kernel abortion rates of inducer lines in the NP2222 background. The transgenic events tested are given on the left followed by the number of testcrosses made ("ears") and the progeny statistics.

| Event | ID | Mutation(s) | Ears | Kernel Characteristics | | | Ploidy Analysis Data | | | HIR |
|---|---|---|---|---|---|---|---|---|---|---|
| | | | | Avg. viable | Avg. aborted | % aborted | Total Embryos | Putative Haploids | Confirmed Haploids | |
| 39A | 3954 | Biallelic (13 bp & 28 bp dels) | 4 | 162 | 128 | 44.10% | 579 | 37 | 35 | 6.04% |
| 23A | 3924 | Biallelic (8 bp & 5 bp dels) | 2 | 114 | 116 | 50.40% | 128 | 18 | 16 | 12.50% |
| 81A | 3932 | Homozygous (13 bp del) | 2 | 165 | 129 | 43.90% | 169 | 18 | 15 | 8.88% |
| 81A | 3317 | Homozygous (13 bp del) | 2 | 183 | 108 | 37.10% | 343 | 19 | 19 | 5.54% |
| 81A | 3303 | Homozygous (13 bp del) | 1 | 189 | 100 | 34.60% | 176 | 7 | 7 | 3.98% |
| 38A | 4108 | Biallelic (11 bp & 5 bp dels) | 4 | 147 | 102 | 40.10% | 379 | 28 | 26 | 6.86% |
| 18A | 22807-4016 | Homozygous (8 bp del) | 8 | 144 | 97 | 40.20% | 1025 | 47 | 44 | 4.29% |
| 27A | 22807-4073 | Biallelic (1 bp insert & 5 bp del) | 2 | 161 | 92 | 36.40% | 180 | 18 | 18 | 10.00% |
| 27A | 22807-4081 | Biallelic (1 bp insert & 8 bp del) | 6 | 176 | 116 | 39.80% | 931 | 45 | 44 | 4.73% |
| 76A | 22873-3999 | Homozygous (2 bp insert) | 2 | 175 | 95 | 35.20% | 117 | 17 | 16 | 13.68% |
| 32A | 22873-3991 | Homozygous (1 bp del) | 2 | 140 | 105 | 42.90% | 260 | 14 | 14 | 5.38% |
| Total | | Totals | 15 | 160 | 108 | 40% | 390 | 24 | 23 | 7% |

Figure 4:
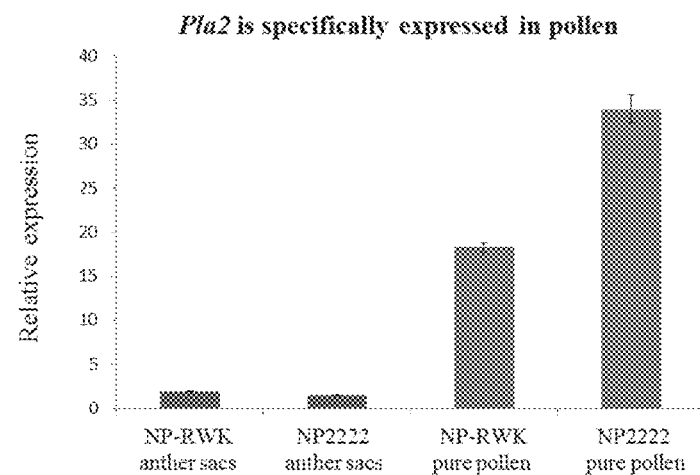
FIG. 4 shows the difference in expression of GRMZM2G471240 in haploid inducer and non-inducer pollen and post-anthesis anther sacs (sporophytic tissue with the pollen grains removed). This gene is specifically expressed in the male gametophyte.
Figure 5A:
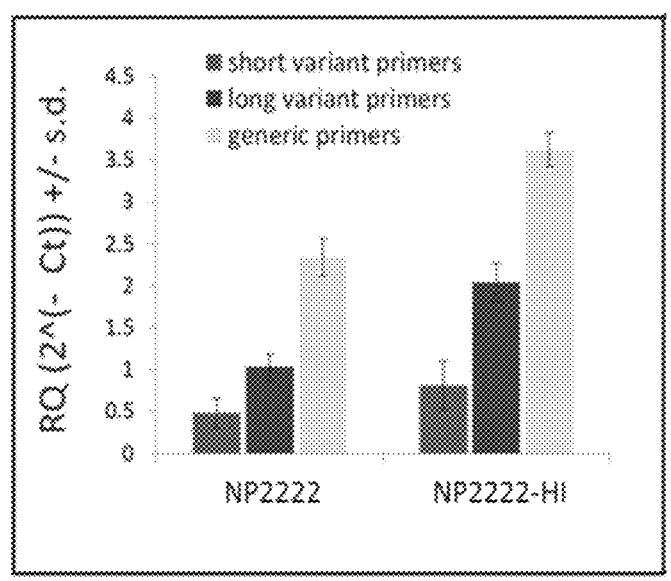
FIG. 5A shows splice-specific qRT-PCR results for GRMZM2G471240. Three biological replicates of R1-staged anthers were tested in technical triplicate, and the average Ct and standard deviation was calculated for each reaction. The relative quantity of each transcript type was compared to the endogenous control using a $\log_2$ regression of the delta Ct. Two sets of primers were used to assess the relative abundance of each of the two annotated splice variants compared to a primer set that is agnostic with respect to the splice variants. The shorter transcript variant had relatively low abundance compared to the long transcript in both NP2222 (wild type) and NP2222-HI (haploid inducer) genotypes. Expression of the mutant copies of the gene in NP2222-HI was significantly higher for all three primer pairs tested.
Figure 5B:
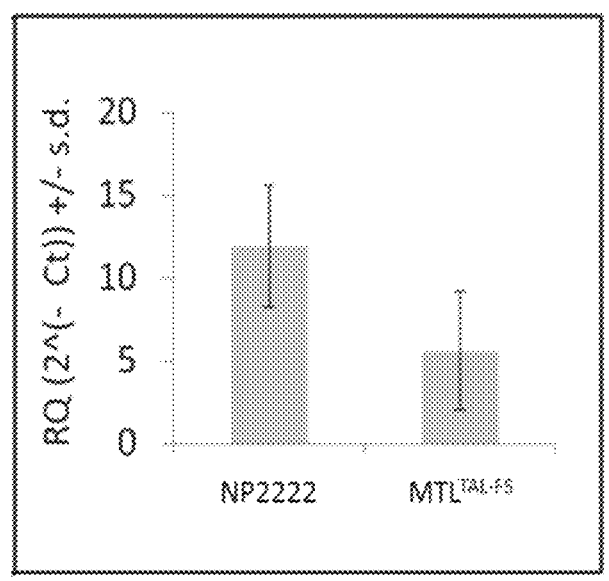
FIG. 5B shows five biological replicates of fresh pollen from NP2222 and MTL$^{TAL-FS}$ plants (T1 plants that are homozygous for edited mtl-like alleles) were tested in technical triplicate on the generic primer, and the average Ct and standard deviation was calculated for each reaction. The relative quantity of each transcript type was compared to the endogenous control using a $\log_2$ regression of the delta Ct. MTL$^{TAL-FS}$ pollen has lower transcript abundance than NP2222 (wild type) pollen.

Haploid seed formation in maize is a post-zygotic character triggered by a defective male gametophyte. This fact is reflected in MTL expression data. Public RNA-seq profiles indicate the wild-type MTL transcript is specific to anthesis-staged anthers (see Sekhon, R. S., et al. *Genome-wide atlas of transcription during maize development*, Plant Journal, 66, 553-563 (2011), incorporated herein by reference), in agreement with a developmental profile that found it exclusively in pre-dehiscent anthers (see Zhai, J., et al. *Spatiotemporally dynamic, cell-type-dependent premeiotic and meiotic phasiRNAs in maize anthers*, PNAS 112, 3146-3151 (2015), incorporated herein by reference). We found that wild-type pollen had 18× more MTL transcript than post-anthesis anther sacs, indicating the gene is male gametophyte-specific (FIG. 4). Attempts to knockdown MTL by RNAi led to elevated rates of haploid formation for MTL$^{RNAi}$ only (Table 12). There are two annotated splice variants of MTL, reflecting an alternative splice site 81 nucleotides prior to the 3' end of exon 2. Compared to NP2222, Mtl was elevated in NP2222-HI but not MTL$^{TAL-FS}$ pollen (FIG. 5), while the abundance of the two annotated splice variants was consistent.

TABLE 12

RNAi construct 22503 (SEQ ID NO: 95) to knockdown Mtl led to haploid induction.

GRMZM2G471240
RNAi

| Individual ID | Event ID | ears | Kernel Characteristics | | | Embryos tested for ploidy | | | |
|---|---|---|---|---|---|---|---|---|---|
| | | | viable | aborted | % aborted | embryos | haploids | diploids | HIR |
| 5148 | 001 | 2 | 701 | 43 | 5.78% | 369 | 3 | 366 | 0.81% |
| 5149 | 001 | 2 | 186 | 22 | 10.58% | 166 | 1 | 165 | 0.60% |
| 5153 | 001 | 2 | 625 | 61 | 8.89% | 323 | 7 | 316 | 2.17% |
| 5161 | 001 | 3 | 1116 | 87 | 7.23% | 485 | 4 | 481 | 0.82% |
| 5170 | 028 | 2 | 629 | 23 | 3.53% | 324 | 1 | 323 | 0.31% |
| 5173 | 028 | 2 | 551 | 33 | 5.65% | 322 | 0 | 322 | 0.00% |
| 5187 | 028 | 3 | 379 | 27 | 6.65% | 333 | 9 | 324 | 2.70% |
| 3731 | 014 | 2 | 894 | 23 | 2.51% | 263 | 4 | 259 | 1.52% |
| 3732 | 014 | 2 | 648 | 49 | 7.03% | 351 | 0 | 351 | 0.00% |
| 3736 | 007 | 1 | 277 | 21 | 7.05% | 277 | 0 | 277 | 0.00% |
| 3737 | 007 | 1 | 223 | 49 | 18.01% | 175 | 3 | 172 | 1.71% |
| 3751 | 0055 | 1 | 133 | 6 | 4.32% | 118 | 0 | 118 | 0.00% |
| TOTALS | events | 23 | 6362 | 444 | 6.52% | 3506 | 32 | 3474 | 0.91% |

Figure 6A:
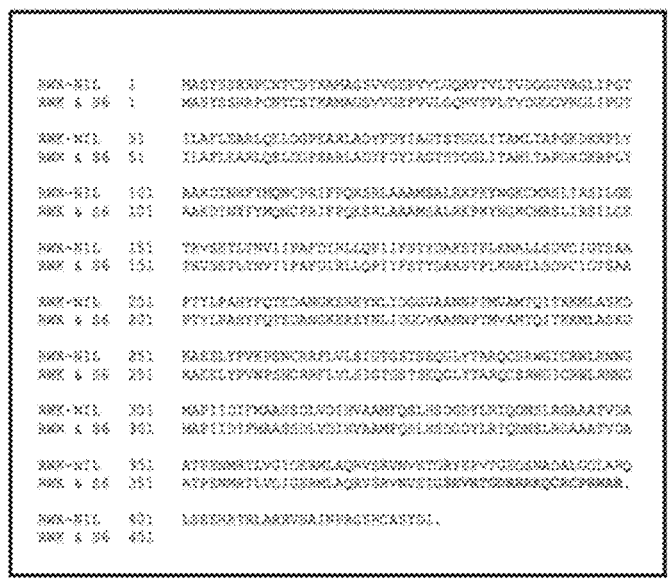
FIG. 6A shows an amino acid alignment of the B73 predicted protein sequence of the long splice variant of the GRMZM2G471240 gene in B73 and RWK-NIL (i.e., SEQ ID NO: 69), with the predicted sequence of the mtl allele found in RWK and Stock 6 (S6) (i.e., SEQ ID NO: 71). Stop codons are indicated with a full stop. Two point mutations result in amino acid substitutions, a histidine (H) to a tyrosine (Y), and a lysine (K) to an arginine (N). These changes are not conservative; it is possible that one or both of these modifies the haploid induction phenotype—suggesting that an allelic series could be uncovered with further investigation of variants.
Figure 6B:
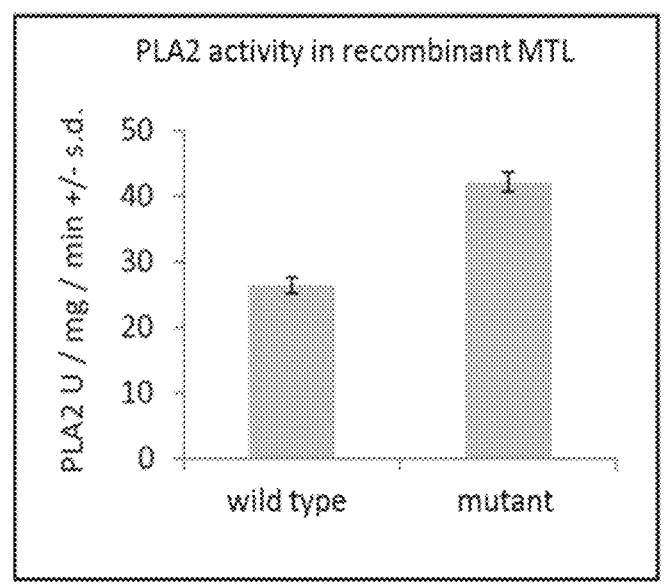
FIG. 6B shows wild type MTL and mutant (truncated) MTL encoded by the mtl allele have in vitro phospholipase activity. PLA2 phospholipase activity as measured by fluorescent liposome assay on recombinant, purified protein produced using the MTL and mtl cDNAs. Error bars indicate standard error based on the average of four replicates.

The frame-shift in mtl occurs at amino acid 380, leading to 20 altered amino acids followed by a premature stop codon which truncates the protein by 29 amino acids (FIG. 6A). The wild-type MTL protein was found in LS-MS profiles of RWK-NIL and NP2222 pollen, but was below the detection limit in three out of three RWK and 3 out of 3 NP2222-HI samples (Table 13). This demonstrates that even though there is mutant mtl transcript produced in pollen, the protein is not detected, confirming this is a loss of function mutation. Both mutant and wild type recombinant MTL proteins exhibited phospholipase activity in vitro in pPLAIIα-like fluorescent liposome cleavage assays (FIG. 6B). This demonstrates that the functional annotation of the MTL gene (i.e. that it codes for a phospholipase protein) is correct.

TABLE 13

Proteins off and on in NP2222 and NP2222-HI pollen samples, including MTL, which is found in NP2222 but not NP2222-HI pollen.

| | log2 LFQ | | | | | | | |
|---|---|---|---|---|---|---|---|---|
| | NP2222 | | | NP2222-HI | | | | |
| | rep 1 | rep 2 | rep 3 | rep 1 | rep 2 | rep 3 | Majority protein ID | best BlastP match (S prot plants) |
| Absent in NP2222-HI | 23.3 | 23.3 | 23.4 | ND | ND | ND | GRMZM2G028905 | L-fucose alpha-1,3-D-xylosyltransferase |
| | 22.9 | 24.1 | 23.9 | ND | ND | ND | GRMZM2G046743 | Lysine histidine transporter 1 |
| | 23.2 | 23.1 | 23.2 | ND | ND | ND | GRMZM2G310362 | Polyadenylate-binding protein 5 |
| | 24.2 | 24.2 | 24.1 | ND | ND | ND | GRMZM2G130121 | Chaperone protein ClpB2, chloroplastic |
| | 23.5 | 23.5 | 23.6 | ND | ND | ND | GRMZM2G375807 | ABC transporter D; COMATOSE |
| | 24.1 | 23.7 | 23.9 | ND | ND | ND | GRMZM2G396212 | Phospho-2-dehydro-3-deoxyheptonate aldolase 1 |
| | 23.7 | 23.8 | 23.9 | ND | ND | ND | GRMZM2G467907 | RNA-binding protein 47 |
| Absent in NP2222 | 23.8 | 23.8 | 23.9 | ND | ND | ND | GRMZM2G471240 | Matrilineal |
| | ND | ND | ND | 23.9 | 23.8 | 23.9 | GRMZM2G013607 | Ferredoxin-6, chloroplastic |
| | ND | ND | ND | 22.1 | 22.1 | 22.2 | GRMZM2G030971 | Phospholipase A I |
| | ND | ND | ND | 24.5 | 24.6 | 24 | GRMZM2G064967 | Mannan endo-1,4-beta-mannosidase |
| | ND | ND | ND | 24 | 24.3 | 24.2 | GRMZM2G143613 | F-box protein |
| | ND | ND | ND | 24.4 | 24.3 | 24.1 | GRMZM2G166906 | HOTHEAD (synth long-chain a-dicarboxylic FAs) |
| | ND | ND | ND | 23.2 | 23.5 | 23.6 | GRMZM2G181259 | beta-D-xylosidase 2 |

*ND, Not detected

Example 16. Pollen Germination and Localization Experiments

Full length functional reporter lines were used to characterize MTL localization. No signal was found in the pollen of NP2222 or NP2222+mtl-GFP/mtl-GFP. In contrast, NP2222+MTL-GFP/MTL-GFP pollen exhibited a strong signal in the cytoplasm of the two sperm cells. This signal was found in the stringy gamete cytoplasm within germinated pollen tubes. NP2222 embryo sacs fixed 18 hours after pollination with MTL-GFP pollen had signal in the area of the degenerating synergid consistent with that of SCs delivered during fertilization. This indicates MTL is part of the male germ unit that is deposited in the embryo sac after pollen tube burst. MTL-GFP but not mtl-GFP eliminated haploid induction in NP2222-HI (Table 10). Collectively these data indicate that MTL is a phospholipase specific to the SC cytoplasm, and that the frame-shift in mtl compromises MTL localization or stability in haploid inducer pollen.

Figure 7A:
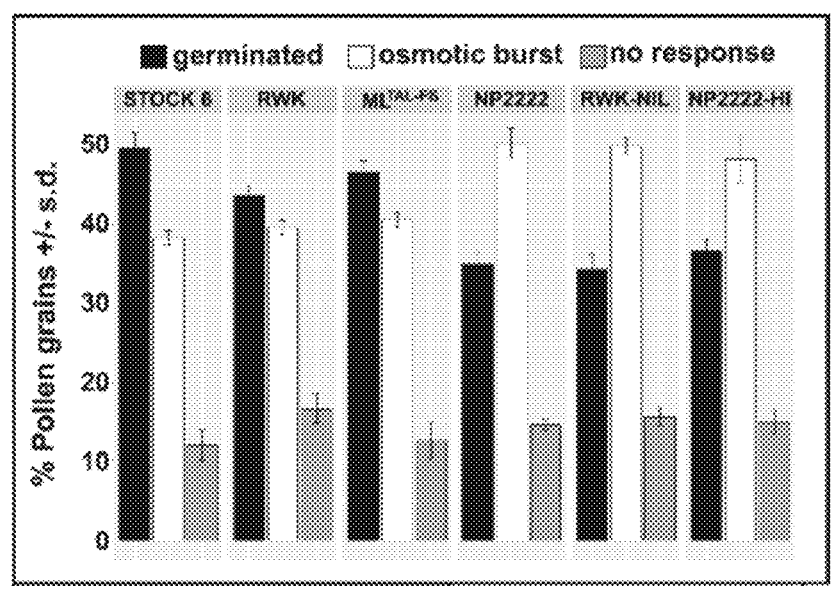
FIG. 7A-E shows mtl is responsible for pleiotropic phenotypes associated with haploid induction.
Figure 7B:
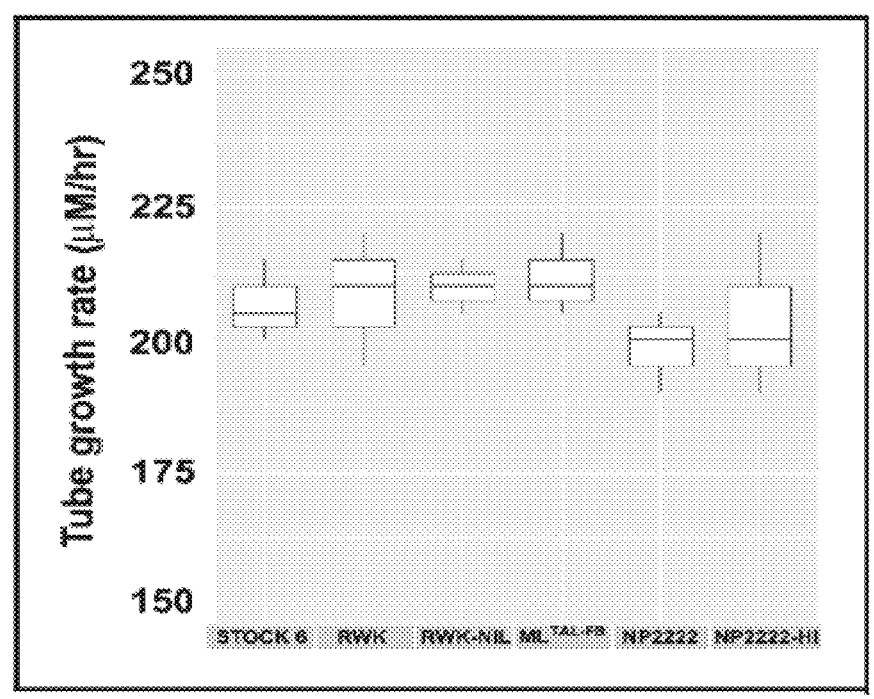
Figure 7C:
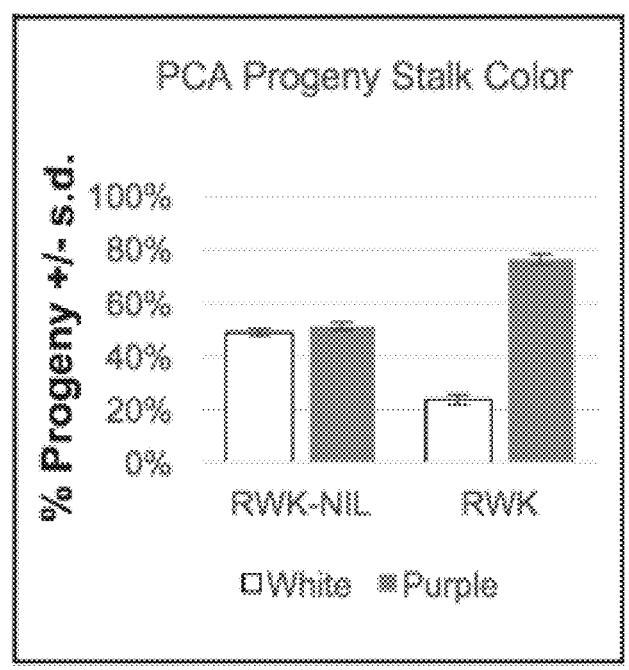
Figure 7D:
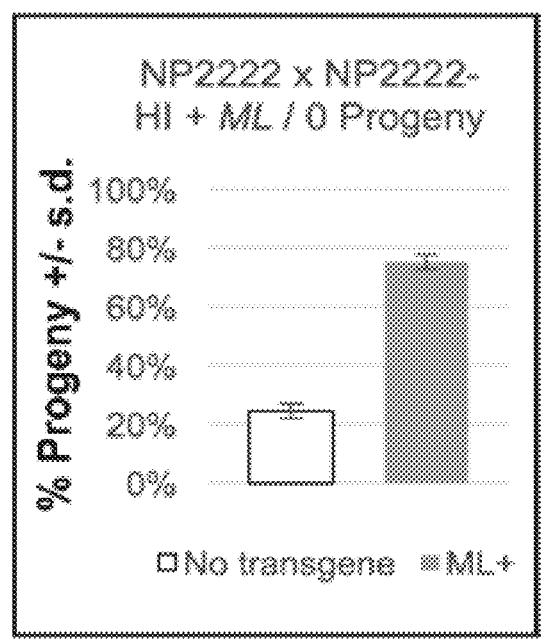
Figure 7E:
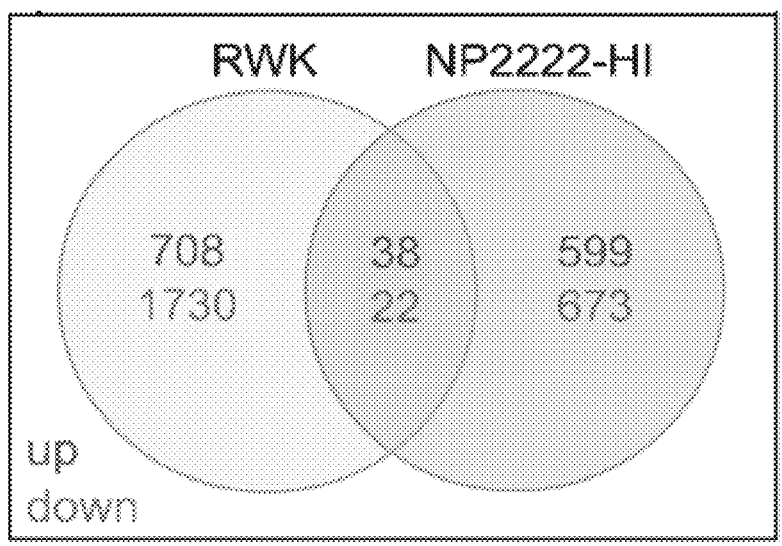

The identification of MTL as the causative gene in maize haploid induction permitted dissection of the pleiotropic phenotypes historically associated with the trait. Phospholipase mutations are associated with delayed pollen germination and tube growth (see Kim, H. J., et al. *Endoplasmic reticulum-and golgi-localized phospholipase A2 plays critical roles in Arabidopsis pollen development and germination*, Plant Cell 23, 94-110 (2011)), but these were normal in RWK, Stock 6 and MTL$^{TAL-FS}$ lines (FIG. 7A, 7B). Ears pollinated with NP2222-HI and MTL$^{TAL-FS}$ pollen exhibit ~10-25% fertilization failure, and a pollen competition assay showed that RWK is subject to segregation distortion (SD) (FIG. 7C), consistent with prior reports (see Xu, X., et al. *Gametophytic and zygotic selection leads to segregation distortion through in vivo induction of a maternal haploid in maize*, J. Exp. Bot. 64, 1083-1096 (2013)). Crosses with hemizygous NP2222-HI+MTL/0 pollen produced a proportional bias towards MTL+ progeny (FIG. 7D), indicating that inducer SD is attributable to mtl. Embryo abortion, a persistent byproduct of haploid induction linked to endosperm proliferation failure, occurred at similar rates in native and MTL$^{TAL-FS}$ inducers (Table 4). Collectively these data implicate mtl in every reproductive defect associated with haploid induction. The two mechanisms typically proffered to explain haploid formation are single fertilization and post-zygotic genome elimination (see Sarkar, K. R. & Coe, E. H, *A genetic analysis of the origin of maternal haploids in maize*, Genetics 54, 453-464 (1966); Zhang, Z., et al., *Chromosome elimination and in vivo haploid production induced by Stock 6-derived inducer line in maize (Zea mays L)*, Plant Cell Rep. 27, 1851-1860 (2008); and Barret, P., Brinkmann, M., & Beckert, M., *A major locus expressed in the male gametophyte with incomplete penetrance is responsible for in situ gynogenesis in maize*, Theor. Appl. Genet. 117, 581-594 (2008)). In the former, haploids result from fertilization of the central cell but not the egg, which subsequently develops via parthenogenesis. In the latter, double fertilization precedes male chromosome elimination. Clarifying the precise mechanism will require careful embryology after MTL$^{TAL-FS}$ pollinations, along with quantitative data tracking the rare persistence of male DNA in maize haploids.

Figure 8:
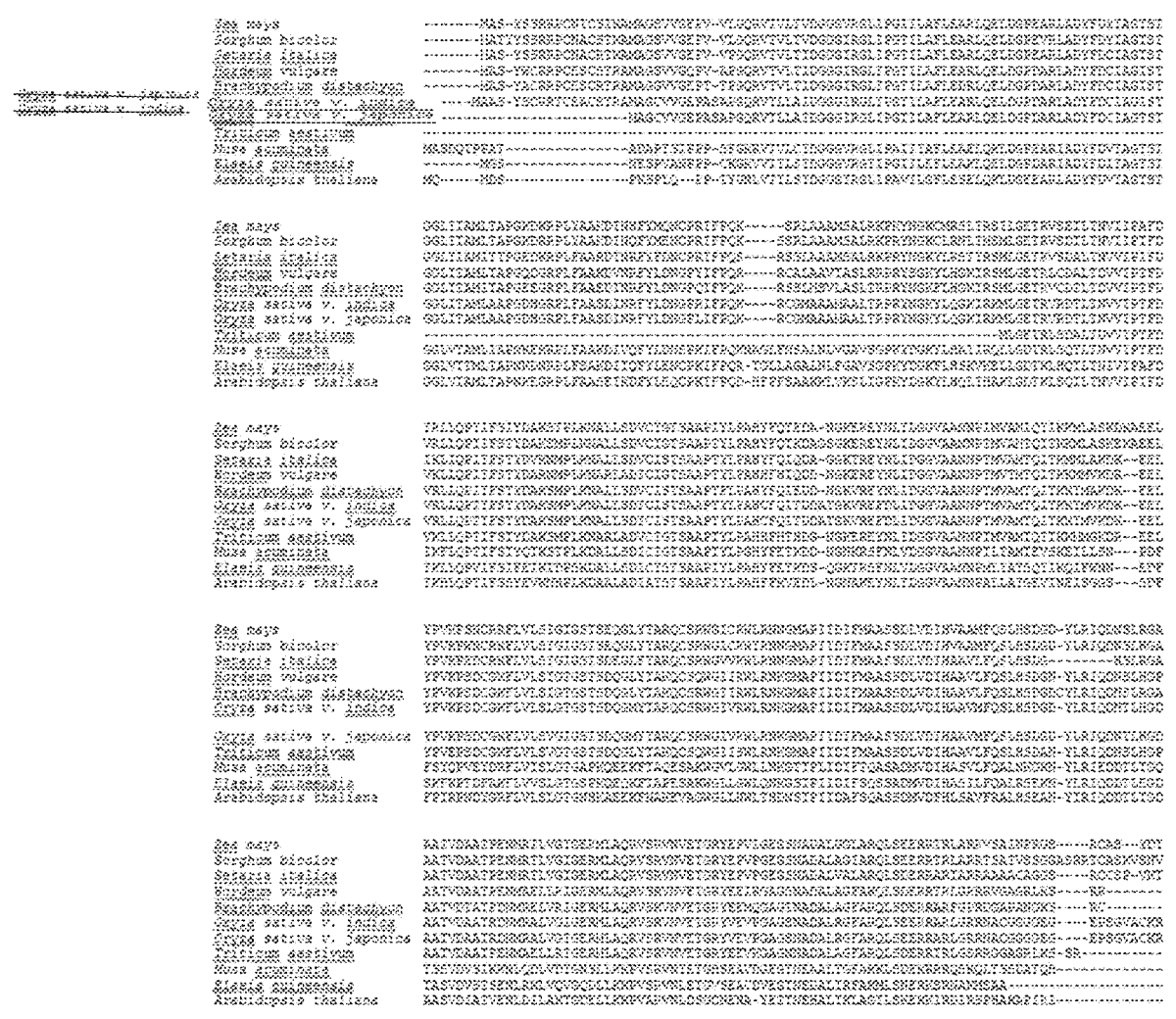

Haploid induction was recently engineered in *Arabidopsis* via manipulation of CENTROMERIC HISTONE3, which causes uniparental genome elimination through post-zygotic centromere imbalance between hybridized genomes. An attempt to replicate this in maize was successful (see Ravi, M. & Chan, S. W. L. *Haploid plants produced by centromere-mediated genome elimination*, Nature 464, 615-618 (2010)), but this filing is the first instance of a haploid inducer system triggered by a cytoplasmic protein that does not bind chromatin. Thus, this work highlights the importance of non-nuclear sperm components in reproductive success and faithful genome transmittance. The conservation of MTL in the grasses (see FIG. 8), especially in rice where the closest homolog is pollen-specific and also found in sperm, suggests these findings will lead to the development of novel intra-specific haploid inducer lines in important crop plants.

Example 17. Mutagenesis and Knockouts of PLA

In an effort to alter the haploid induction rate or decrease the embryo abortion rate during haploid induction crosses, we created or obtained several mutant lines by several methods, including GM RNAi lines, TILLING lines, CRISPR lines, and TALEN lines. First, we sought evidence that targeted mutagenesis of pPLAIIα is a viable strategy to create new haploid inducer lines. Therefore, we tested both CRISPR/CAS9 and TALEN maize targeted mutation strategy aimed at the same sequence that contains the frame-shift in the mutant haploid inducer allele. This led to the generation of lines with novel mutations, which we tested for haploid induction.

There are three key components to the CRISPR process. See U.S. Pat. No. 8,697,359 B1, incorporated herein by reference in its entirety. The first key component is the target sequence. The second is the Cas9, which is the endonuclease. The third key component is the guide RNA ("gRNA"), which is complementary to the target sequence and is responsible for recruiting Cas9 to the desired location. The target sequence is 18 to 20 bp long, and optimally should be sitting just 5' to a protospacer adjacent motif ("PAM") in the plant genome. For Cas9 from *Streptococcus pyogenes*, the PAM sequence should be 5'-NGG-3'. Transcription of the gRNA can be driven by the Pol III promoter U3 (RNA starts with an A) or U6 (RNA starts with a G). The gRNA should carry target sequence at the 5' end right after the A (U3) or G (U6). Cas9 will generate a double-stranded break ("DSB") at the target sequence three base pairs 5' to the PAM sequence. The amino acid sequence of Cas9 is the same as Cas9 from *Streptococcus pyogenes* strain SF370, with two amino acid changes, L1164V and I1179V in the PI domain (1099-1368) in NUC lobe. Cas9 activity has been demonstrated in transformation experiments to have approximately a 90% mutation frequency of tested target sequence in corn. Generally, it is advisable to identify multiple candidate PAMs and target sequences in the target region, then look for the best one by seeing which of the sequences is unique in the genome of the target. The target plant is maize, rice, or any monocot plant.

This strategy was followed to identify CRISPR target sequences that overlap with the existing frame-shift mutation. The precise cut site is just two base pairs away from the insertion point in the frame-shift. Constructs containing both the Cas9 and the gRNA were transformed into maize plants. Generally, biallelic or homozygous mutant plants are recoverable from the multiple events generated, but heterozygous mutant plants are also useful. The heterozygous plants were selfed, then the T1 seed was grown up, screened for homozygosity of the mutation, and outcrossed. Homozygous or biallelic mutant T0 transformants were simply selfed and outcrossed to untransformed NP2222. All outcrossed embryos were isolated for ploidy analysis to find haploids.

Three different targeted mutagenesis constructs created: CRISPR/CAS9 I, CRISPR/CAS9 II, and TALEN. The difference between CRISPR/CAS9 I and II is minor. The target site locus for all three constructs was the same region where the frame-shift was found in haploid inducer lines. For the CRISPR constructs, the guide RNA sequence starts at nucleotide+1560: -GTCAACGTGGAGACAGGG- (i.e., SEQ ID NO: 83). The -AGG-PAM site of SEQ ID NO: 83 is underlined and italicized. The four basepair insertion in haploid inducer lines is at that exact site, at nucleotide+ 1576. After transformation, several different CRISPR I events (comprising the expression construct found in SEQ ID NO: 97), CRISPR II events (comprising the expression construct found in SEQ ID NO: 99), and TALEN events (comprising the expression construct found in SEQ ID NO: 98) were selected, grown to maturity, and set viable seed. In the T0 generation, we performed PCR at the target site and sequenced the PCR products after sub-cloning. We identified many unique mutations amongst those events (and many of the events were chimeras or had multiple alleles).

Many plants were chimeric, as evidenced by multiple different sequences appearing in the T1 generation. After T0 self-pollination, the T1 plants segregated 1:2:1 for the target mutagenesis construct, and many had novel mutations at the target locus in either a biallelic or homozygous state. We screened seedlings at the DNA level using TAQMAN markers, identified the biallelics that lacked the Cas9 or TALEN transgenes, and performed PCR sequencing to produce PCR product reading basepairs +1494 to +1691 in the GRMZM2G471240 gene sequence. We then tested homozygous mutants for haploid induction capacity. See SEQ ID NOs: 9-19 and 42-44 for the sequences of the new T1 plants at the mtl gene.

The HIR was measured for the putative new lines. See Table 11, above. This HIR data is from crosses where the male was a putative haploid inducer line and the female was our standard inbred transformation line NP2222. The putative haploid inducer lines were created using either TALEN- or CRISPR/CAS9-mediated targeted mutation of the pPLAIIα locus. Among those shown here, there are eleven different putative inducer plants comprising eight different events from three distinct transformation constructs. Event 39A was a TALEN event. Events 18A and 27A were CRISPR events. The latter was a chimera as a T0 plant, and after it was self-pollinated, multiple mutations were found in the T1 population, including "biallelic" plants (by biallelic, we mean that when we sequenced the region of pPLAIIα that was mutated, we found two different novel alleles— such that it is clear that both wild type copies of the gene had been mutated, but they were mutated differently, so there are two novel alleles). Each of these eleven individual plants thus had distinct combinations of mutations in pPLAIIα. What they all had in common is that none of the eleven plants had a wild type copy of pPLAIIα. Therefore, these are all "homozygous mutant" for the pPLAIIα gene. The mutations were all frameshifts in exon 4, mimicking the original mutation in the native haploid inducer lines. Using these five plants as males, we crossed onto either one or several female ears, generating thousands of embryos. We dissected and did ploidy analysis on those progeny and discovered that each of the progeny sets had at least 3.98% haploids with a maximum of 12.5% haploids. This demonstrates that generating mutations in pPLAIIα will lead to haploid induction. We think that other types of mutations, besides frameshifts, will also lead to haploid induction. Those mutations could be anywhere in the gene, and they could be point mutations or insertions or deletions or other types of mutations.

Figure 9:
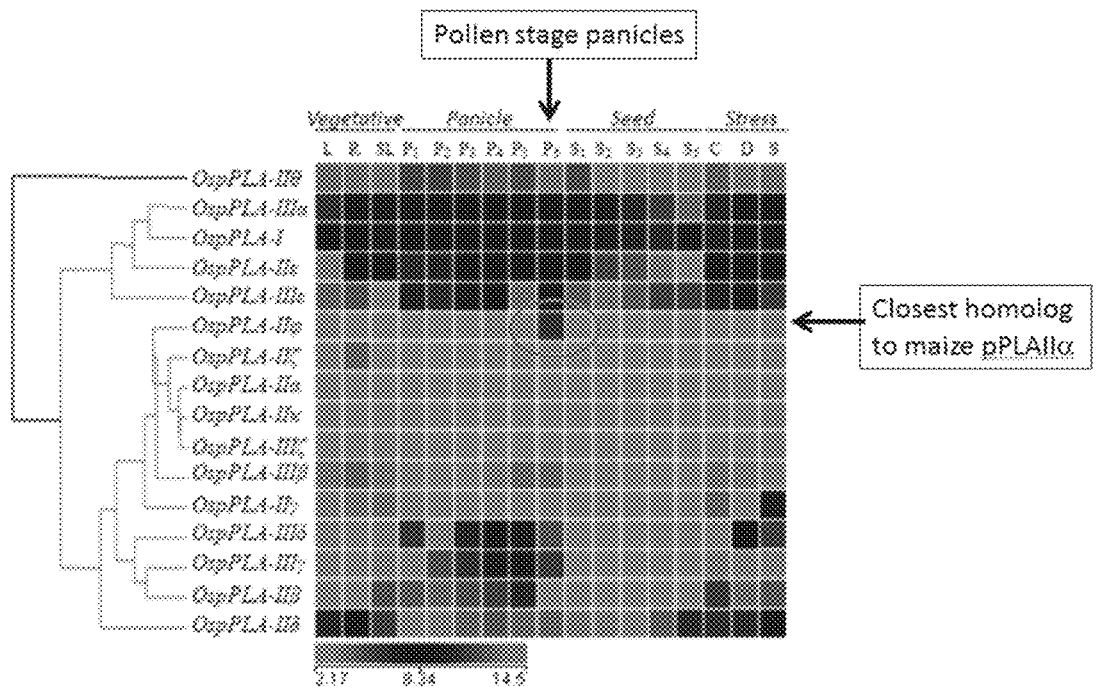
FIG. 9. Expression profile of rice phospholipases (adapted from Singh, A., et al., *Rice phospholipase A superfamily: organization, phylogenetic and expression analysis during abiotic stresses and development*, PLoS One 7: e30947 (2012)). The closest homolog to MTL is the rice gene OspPLAIIφ (Os3g27610).
Figure 10:
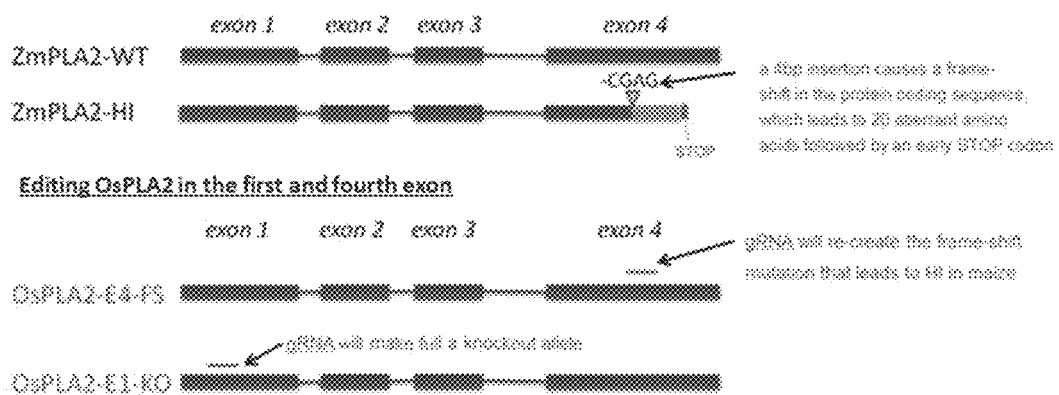
FIG. 10. Diagram showing a route to editing Os3g27610 in order to make haploid inducer lines. One could target any part of the gene (shown here—targeting the first and fourth exons) and expect to create frame-shift mutations that would lead to knockout and loss of function of the gene, and that will lead to haploid induction.

RNAi was also used to generate haploid inducer lines. For the RNAi, two hairpin constructs were made; one mapping to the border between exon 1 and 2, and the other mapping to exon 4 (FIGS. 9 and 10). The constructs were transformed into wild-type and the T0 plants were selfed. The T1 seed from three events per construct were grown, screened for homozygosity of the transgene, and outcrossed onto several ears as tests for haploid induction. After examining over 1500 kernels from these outcrosses, we found both events induce haploids at a rate of approximately 1% to 2%. The highest rate of haploid induction obtained on a single ear was 4.3%. That ear had about 300 kernels, so we can conclude that the embryo abortion rate was also lower than a typical high-inducer line. This work demonstrates than an RNAi+GM strategy can be used to create new haploid inducer lines in otherwise-typically wild-type lines by altering the expression of pPLAIIα.

The TILLING mutagenesis method was also used to create and identify the phospholipase mutations and maize of the present invention. Publications describing TILLING are available for crop plants such as rice: Till et al., *BMC Plant Biology* 7:19 (2007), tomato: Rigola et al. PLOS ONE Mar. 13, 2009, and maize: Till et al. *BMC Plant Biol.* 2004 Jul. 28; 4:12 (2004), all of which are incorporated herein by reference. In the basic TILLING methodology, plant material, such as seed, is subjected to chemical mutagenesis, which creates a series of mutations within the genomes of the seeds' cells. The mutagenized seeds are grown into adult M1 plants and self-pollinated. DNA samples from the resulting M2 plants are pooled and are then screened for mutations in a gene of interest. Once a mutation is identified in a gene of interest, the seeds of the M2 plant carrying that mutation are grown into adult M3 plants and screened for the phenotypic characteristics associated with the gene of interest.

Any cultivar of maize having at least one phospholipase gene with substantial homology to SEQ ID NO: 68 may be used in accordance with the present invention. As used herein, "substantial homology" means that the DNA sequence of the gene is sufficiently similar to SEQ ID NO: 68 at the nucleotide level to code for the equivalent protein as SEQ ID NO: 68, allowing for allelic differences between cultivars. In accordance with one aspect of an exemplary embodiment of the invention, "substantial homology" may be present when the homology between the phospholipase gene and SEQ ID NO: 68 is as low as about 85%, provided that the homology in the conserved regions of the gene is higher (e.g., at least about 90%). Preferably, the percent identity in the coding region is 85-90%, more preferably 90-95%, and optimally, it is above 95%. One of skill in the art may prefer a maize cultivar having commercial popularity or one having specific desired characteristics in which to create the phospholipase-mutated maize. Alternatively, one of skill in the art may prefer a maize cultivar having few polymorphisms, such as an in-bred cultivar, in order to facilitate screening for mutations within the phospholipase loci.

In accordance with one aspect of an exemplary embodiment of the present invention, seeds from rice and maize were mutagenized and then grown into M1 plants. The M1 plants were then allowed to self-pollinate and seeds from the M1 plant were grown into M2 plants, which were then screened for mutations in their phospholipase locus. While M1 plants may be screened for mutations, an advantage of screening the M2 plants is that all somatic mutations correspond to the germline mutations. One of skill in the art would recognize that a variety of maize plant materials, including, but not limited to, seeds, pollen, plant tissue or plant cells, may be mutagenized in order to create the phospholipase-mutated maize of the present invention. However, the type of plant material mutagenized may affect when the plant DNA is screened for mutations. For example, when pollen is subjected to mutagenesis prior to pollination of a non-mutagenized plant, the seeds resulting from that pollination are grown into M1 plants. Every cell of the M1 plants will contain mutations created in the pollen, thus these M1 plants may then be screened for phospholipase mutations instead of waiting until the M2 generation.

Mutagens that create primarily point mutations and short deletions, insertions, transversions, and or transitions (about 1 to about 5 nucleotides), such as chemical mutagens or radiation, may be used to create the mutations of the present invention. Mutagens conforming with the method of the present invention include, but are not limited to, ethyl methanesulfonate (EMS), methylmethane sulfonate (MMS), N-ethyl-N-nitrosurea (ENU), triethylmelamine (TEM), N-methyl-N-nitrosourea (MNU), procarbazine, chlorambucil, cyclophosphamide, diethyl sulfate, acrylamide monomer, melphalan, nitrogen mustard, vincristine, dimethylnitosamine, N-methyl-N'-nitro-Nitrosoguanidine (MNNG), nitrosoguanidine, 2-aminopurine, 7,12 dimethyl-benz(a)anthracene (DMBA), ethylene oxide, hexamethylphosphoramide, bisulfan, diepoxyalkanes (diepoxyoctane (DEO), diepoxybutane (BEB), and the like), 2-methoxy-6-chloro-9 [3-(ethyl-2-chloro-ethyl)aminopropylamino]acridine dihydrochloride (ICR-170), and formaldehyde. Spontaneous mutations in the nucleolar organizing region ("NOR") that may not have been directly caused by the mutagen can also be identified in accordance with various embodiments of the present invention.

Any suitable method of plant DNA preparation now known or hereafter devised may be used to prepare the maize plant DNA for phospholipase mutation screening. For example, see Chen and Ronald, Plant Molecular Biology Reporter 17:53-57, 1999; Stewart and Via, Bio Techniques 14:748-749, 1993. Additionally, several commercial kits are available, including kits from Qiagen (Valencia, Calif.) and Qbiogene (Carlsbad, Calif.).

In accordance with one aspect of an exemplary embodiment of the invention, DNA samples from individual maize plants are prepared and then pooled in order to expedite screening for mutations in phospholipase of the entire population of plants originating from the mutagenized plant tissue. The size of the pooled group may be dependent upon the sensitivity of the screening method used. In accordance with one aspect of an exemplary embodiment of the invention, groups of four or more individual maize plants are pooled.

In accordance with another aspect of an exemplary embodiment, after the DNA samples are pooled, the pools are subjected to phospholipase sequence-specific amplification techniques, such as Polymerase Chain Reaction (PCR). For a general overview of PCR, see PCR Protocols: A Guide to Methods and Applications (Innis, Gelfand, Sninsky, J., and White, eds.), Academic Press, San Diego, 1990, which is incorporated herein by reference. Any primer specific to the phospholipase locus or the sequences immediately adjacent to the phospholipase locus may be utilized to amplify the phospholipase sequences within the pooled DNA sample. Preferably, the primer is designed to amplify the regions of the phospholipase locus where useful mutations are most likely to arise. Most preferably, the primer is designed to detect mutations in the coding region of the phospholipase gene. Additionally, it is preferable for the primer to avoid known polymorphic sites in order to ease screening for point mutations. To facilitate detection of PCR products on a gel, the PCR primer may be labeled using any conventional or hereafter devised labeling method.

In accordance with one aspect of an exemplary embodiment of the invention, the PCR amplification products may be screened for phospholipase mutations using any method that identifies nucleotide differences between wild type and mutant sequences. These may include, without limitation, sequencing, denaturing high pressure liquid chromatography (dHPLC), constant denaturant capillary electrophoresis (CDCE), temperature gradient capillary electrophoresis (TGCE) (see Li et al., Electrophoresis 23(10):1499-1511, 2002), or by fragmentation using enzymatic cleavage, such as used in the high throughput method described by Colbert et al., Plant Physiology 126:480-484, 2001. Preferably, the PCR amplification products are incubated with an endonuclease that preferentially cleaves mismatches in heteroduplexes between wild type and mutant sequences. In accordance with another aspect of an exemplary embodiment, cleavage products are electrophoresed using an automated sequencing gel apparatus, and gel images are analyzed with the aid of a standard commercial image-processing program.

typic analysis of the maize plant containing that mutation is pursued. First, the M2 plant is backcrossed or outcrossed twice to create a BC1 plant in order to eliminate background mutations. Then the backcrossed or outcrossed BC1 plant is self-pollinated in order to create a BC1F2 plant that is homozygous for the phospholipase mutation.

Several physical characteristics of these homozygous phospholipase mutant plants are assessed to determine if the mutation results in a useful phenotypic change in the maize. Mutant phospholipase maize are evaluated for haploid induction compared to normal (e.g., wild type) parental maize or to wild type sibling control maize. Table 14 shows novel mutations obtained by TILLING.

TABLE 14

Novel pPLAIIα Mutations Obtained by TILLING & their HIR. The nucleotide change column represents the position from the start of the cDNA sequence (SEQUENCE No. 1), and the changed nucleotide is capitalized within its codon context. The amino acid change is then indicated followed by the impact of that change (Tolerated or Not Tolerated). Of the two alleles that were not tolerated, one induced haploids at a rate of 1.04% (3/288).

| Line | Nucleotide change | Exon | AA change | Tolerated? | Diploids | Haploids | PA confirmed | HIR |
|---|---|---|---|---|---|---|---|---|
| 1139 | bp + 128 tGt/tAt | 1 | C13Y | Yes | 389 | 0 | 0 | 0.00% |
| 3594 | bp + 167 cCc/cTc | 1 | P26L | Yes | 381 | 0 | 0 | 0.00% |
| 0505 | bp + 431 cCg/cTg | 1 | P114L | No | 235 | 0 | 0 | 0.00% |
| 2658 | bp + 718 Gcg/Acg | 4 | A237T | Yes | 379 | 0 | 0 | 0.00% |
| 1983 | bp + 1077 atG/atA | 4 | M356I | No | 285 | 3 | 3 | 1.04% |
| 2732 | bp + 1163 aCt/aTt | 4 | T385I | Yes | 383 | 0 | 0 | 0.00% |
| 2414 | bp + 1226 aGa/aAa | 4 | R406K | Yes | 392 | 0 | 0 | 0.00% |

The present inventors have determined that to achieve haploid induction in maize, mutations that alter phospholipase function are desirable. Preferred mutations include missense, nonsense and splice junction changes, including mutations that prematurely truncate the translation of the phospholipase protein from messenger RNA, such as those mutations that create a stop codon within the coding regions of the phospholipase gene. Such mutations include insertions, repeat sequences, modified open reading frames (ORFS) and, most preferably, point mutations.

In accordance with yet another aspect of an exemplary embodiment of the invention, once an M2 plant having a mutated phospholipase sequence is identified, the mutations are analyzed to determine its effect on the expression, translation, and/or activity of the protein. In accordance with one exemplary embodiment, the phospholipase fragment containing the mutation is sequenced, using standard sequencing techniques, in order to determine the exact location of the mutation in relation to the overall phospholipase sequence. Each mutation is evaluated in order to predict its impact on protein function (i.e., completely tolerated to loss-of-function) using bioinformatics tools such as SIFT (Sorting Intolerant from Tolerant; Ng et al., Nucleic Acids Research 31:3812-3814, 2003), PSSM (Position-Specific Scoring Matrix; Henikoff and Henikoff, Computer Applications in the Biosciences 12:135-143, 1996) and PARSESNP (Taylor and Greene, Nucleic Acids Research 31:3808-3811, 2003). For example, a SIFT score that is less than 0.05 and a large change in PSSM score (e.g., roughly 10 or above) indicate a mutation that is likely to have a deleterious effect on protein function.

In accordance with a further aspect of an exemplary embodiment, if the initial assessment of a mutation in an M2 plant indicates it to be of a useful nature and in a useful position within the phospholipase gene, then further pheno- The nomenclature used in the Table 14 indicates the wild type nucleotide or amino acid, followed by its position according to the referenced SEQ ID NO: 68, followed by the changed nucleotide or amino acid at that position using standard genetic code terminology.

For maize, TILLING the maize pPLAIIα gene generates new alleles which have low rates of haploid induction. This enables the creation of an allelic series, including knockouts, of GRMZM2G471240. The sequence of two segments of this gene (maximum 1.5 kb, which equals 20 amplicons per gene) are screened for mutations. These sequences included the genomic sequence including introns, plus the predicted cDNA sequence and coding sequences for the two splice variants. Relevant and unique amplicon sequences are designed based on those sequences, and mutation screening is performed in an existing bulked-M2 corn population. The identified mutants are characterized in terms of DNA sequence and consequences on translated protein sequence. The M3 seed is grown and selfed to generate M4 lines with putative mutant homozygous individuals segregating. These individuals are identified by PCR sequencing and outcrossed and selfed to test for these mutant lines' ability to induce haploids.

To execute the test crosses, the new lines are grown alongside a marker line which is homozygous recessive for a non-lethal color marker gene. Reciprocal crosses are used to test the specificity of induction to male vs. female transmission by evaluating the resulting plants for haploids, which exhibit the color phenotype. Positive hits are confirmed by the ploidy analysis as described above.

Individuals that are homozygous for the SNP mutations were crossed as males to the marker line female and led to the formation of a low rate of haploids in some instances. Positive hits are confirmed by the ploidy analysis as described above. In particular, a line that led to haploid formation had a G to A mutation at base pair 1077 of the cDNA sequence. This mutation causes an amino acid substitution of a methionine (M) to an isoleucine (I) at amino acid 356. This is a non-conservative amino acid change that may disrupt the protein's activity leading to the formation of low rate of haploids. Among 288 progeny tested, we found three haploids, for an induction rate of 1% (3/288).

Example 18. Creating Haploid Inducing Lines in Rice

In rice, the closest homolog to the maize pPLAIIα is Os03g27610, a rice patatin-like phospholipase (OspPLAIIφ) with a similar annotation, gene structure and expression pattern, i.e., expressed in pollen and absent elsewhere (FIG. 10). SEQ ID NO: 84 comprises the genomic DNA sequence of Os03g27610, SEQ ID NO: 85 comprises the cDNA sequence, and SEQ ID NO: 86 comprises the amino acid sequence. The close agreement of these features, along with the short evolutionary distance between these two grasses, suggests that a mutation in the rice gene may also give rise to a haploid induction line. In a recent publication the rice protein was detected in sperm nuclei of pollen grains (Abiko et al., 2013), suggesting involvement of this protein in fertilization and/or zygote development.

To improve the haploid induction rate in maize and create the first haploid inducer lines in rice, a reverse genetics TILLING approach was used to obtain novel mutants in the maize GRMZM2G471240 gene and the rice Os03g27610 gene. See McCallum C M et al. (2000) *Targeting induced local lesions IN genomes (TILLING) for plant functional genomics*, Plant Physiol. 123: 439-42, incorporated herein by reference. TILLING provides an unbaised approach to generating new mutants as there is no control by the researcher of where the ethylmethanesulfonate (EMS) mutagen will create new mutations. A diversity and abundance of new alleles were generated and tested for haploid induction rate.

Thirteen different TILLING M3 lines were obtained. See Table 15. The PosGenomic column indicates the nucleotide position of the mutation and the change (e.g., G803A indicates that base pair G at position 803 was changed to an A). The effect is the amino acid change or other protein change that results from the mutation (e.g. A209T indicates that an Alanine at amino acid 209 was changed to a Threonine). The BLOSUM score is a prediction of the strength of the effect the amino acid change will have on the protein's conformation or fold (the more negative, the more severe the effect). The "Type" indicates the type of amino acid change ("NSM" means non-silent mutation; "PSM" means partially silent mutation; "silent" means silent mutation; "splice" means splice site mutation resulting in aberrant splicing; "intron" means mutation is in an intron). Finally the GSOR # is the line ID for the Genetic Stocks—*Oryza* collection at the USDA.

These thirteen lines were selfed to make the M4 and the M4 seed are grown and tested for homozygosity. Homozygous mutant individuals are selfed and outcrossed to test for haploid induction capacity. The resulting progeny are examined for DNA content per cell (ploidy) using the ploidy analyzer.

The non-conservative changes, such as the splice site changes and the changes with most negative BLOSUM scores have the greatest haploid induction potential. These should have the more destabilizing effects on the protein product, and so are the superior haploid induction TILLING alleles compared to the others, giving rise to more haploids per haploid induction cross and likely resulting in partially compromised seed set. Indeed, we have already started to see that in some of the T4 self-pollinations. The line with the lowest seed set was the splice site mutant G153A, with only 29 seeds being recovered per 12 homozygous mutant M4 plants crossed. The other lines had more than 100 recovered.

TABLE 15

TILLING alleles in rice Os03g27610.

| Gene | PosGen | PosTIL | Effect | BLOSUM | Type | GSOR# |
|---|---|---|---|---|---|---|
| Os03g27610 | G803A | G590A | A209T | 0 | NSM | 406317 |
| Os03g27610 | G761A | G548A | D195N | 1 | NSM | 405490 |
| Os03g27610 | G1163A | G950A | G293E | −2 | PSM | 403403 |
| Os03g27610 | G1189A | G976A | G302R | −2 | PSM | 406250 |
| Os03g27610 | T374C | T161C | intron | NA | intron | 403453 |
| Os03g27610 | G1026A | G813A | K247= | NA | silent | 406338 |
| Os03g27610 | C738T | C525T | P187L | −3 | PSM | 405205 |
| Os03g27610 | G1149A | G936A | Q288= | NA | silent | 405898 |
| Os03g27610 | G366A | G153A | splice | NA | splice | 403878 |
| Os03g27610 | G366A | G153A | splice | NA | splice | 405549 |
| Os03g27610 | C792T | C579T | T205I | −1 | PSM | 404794 |
| Os03g27610 | A1021G | A808G | T246A | 0 | NSM | 404534 |
| Os03g27610 | G558A | G345A | V156M | 1 | NSM | 404675 |

Alternately, the rice phospholipase gene found in Os03g27610 may be edited by CRISPR/Cas9 methods. As stated above, there are three key components to the CRISPR process. The first key component is the target sequence. The second is the Cas9, which is the endonuclease. The third key component is the guide RNA ("gRNA"), which is complementary to the target sequence and is responsible for recruiting Cas9 to the desired location. Guide RNAs can be in the form of single guide RNA (sgRNA) or double guide RNA (dgRNA). For rice, we created four constructs targeting the rice phospholipase gene. SEQ ID NO: 101 comprises an expression cassette that provides for dgRNA targeting Os03g27610, in exon 4 very near to where the native four base pair mutation is located in the maize homolog. In the rice gene, the guide RNA target site is GAGACCGGCAGGTACGTCGAGG. SEQ ID NO: 102 comprises an expression cassette that provides for sgRNA targeting Os03g27610, exon 4, at the same gRNA target site as is targeted in SEQ ID NO: 101. The frameshift mutations for both SEQ ID NOs: 101 and 102 are expected to occur where the vertical bar is placed between the G and the T in the sequence CAGGTACG TCGAGG (at base pair +1150 of the gDNA sequence in the SEQ ID NO 85. Therefore, both of these constructs are expected to generate haploid inducer mutations that are only seven base pairs downstream from where the maize haploid inducer insertion is located. These mutations in most cases will be frame-shifting mutations that induce small insertions or deletions, for instance a deletion of a G or a T at the cut site, or any other similar mutation. SEQ ID NO: 103 comprises an expression cassette that provides for dgRNA targeting Os03g27610. SEQ ID NO: 104 comprises an expression cassette that provides for sgRNA targeting Os03g27610. Both of these harbor guide RNAs that target the sequence CCTCGCCGATTACTTCGACTGCA in Exon 1.

This should generate a knockout of the majority of the coding sequence of the gene. The mutation that is generated should occur at the cut site where the vertical bar is placed between the C and the C in the sequence CCTCGC|CGAT-TAC (at base pair +215 of the cDNA sequence in SEQ ID NO 85). Therefore both construct 40 and 41 are expected to generate a high frequency of plants containing knockout mutations of the gene, which should also lead to high haploid induction rates in rice.

Rice plants are transformed with a transformation construct comprising a sequence selected from the group consisting of SEQ ID Nos: 101-104. Through the CRISPR/Cas9 machinery encoded in the transformation construct, new phospholipase alleles are generated in the transformants, i.e., the T0 rice plants. T0 rice plants, are grown and crossed (i.e., self-pollinated) to create T1 plants. The T1 rice plants are tested for homozygosity at the new phospholipase allele. Homozygous T1 rice plants are crossed with a rice line, and resulting progeny are tested for haploidy using a ploidy analyzer. Haploid embryos containing no detectable T1 DNA are identified and counted, and the HIR is measured. At least one haploid embryo is produced from the cross, and the HIR is elevated. Preferably, the HIR is at least 5%. The at least one haploid embryo is treated with a chromosome doubling agent, for example colchicine, and a doubled-haploid plant is grown therefrom.

REFERENCES

All references listed below, as well as all references cited in the instant disclosure, including but not limited to all patents, patent applications and publications thereof, scientific journal articles, and database entries (e.g., GEN-BANK® database entries and all annotations available therein) are incorporated herein by reference in their entireties to the extent that they supplement, explain, provide a background for, or teach methodology, techniques, and/or compositions employed herein.

Abler et al. (1993) Isolation and characterization of a genomic sequence encoding the maize Cat3 catalase gene. *Plant Mol Biol* 22: 1031-1038.

Allison et al. (1986) The nucleotide sequence of the coding region of tobacco etch virus genomic RNA: evidence for the synthesis of a single polyprotein. *Virology* 154:9-20.

Ardlie et al. (2002) Patterns of linkage disequilibrium in the human genome. *Nature Reviews Genetics* 3:299-309.

Ausubel et al. (1988) *Current Protocols in Molecular Biology*, John Wiley & Sons, New York, New York, United States of America.

Barret P, Brinkmann M, Beckert M. 2008. A major locus expressed in the male gametophyte with incomplete penetrance is responsible for in situ gynogenesis in maize. *Theoretical and Applied Genetics* 117, 581-594.

Benfey & Chua (1990) The Cauliflower Mosaic Virus 35S Promoter: Combinatorial Regulation of Transcription in Plants. *Science* 250: 959-966.

Bennett M D, Finch R A, Barclay I R. 1976. The time rate and mechanism of chromosome elimination in *Hordeum* hybrids. *Chromosoma* 54, 175-200.

Bevan (1984) Binary *Agrobacterium* vectors for plant transformation. *Nucl Acids Res* 12:8711-8721.

Bevan et al. (1983) A chimeric antibiotic resistance gene as a selectable marker for plant cell transformation. *Nature* 304:184-187.

Binder et al. (1996) Regulation of gene expression in plant nuclear. *Plant Mol Biol* 32:303-314.

Birchler J A. 1993. Dosage analysis of maize endosperm development. *Annual Review of Genetics* 27, 181-204.

Birchler J A, Gao Z, Sharma A, Presting G G, Han F. 2011. Epigenetic aspects of centromere function in plants. *Current Opinion in Plant Biology* 14, 217-222.

Blair et al. (1999) Inter-simple sequence repeat (ISSR) amplification for analysis of microsatellite motif frequency and fingerprinting in rice (*Oryza sativa* L.). *Theor Appl Genet* 98:780-792.

Blochinger & Diggelmann (1984) Hygromycin B phosphotransferase as a selectable marker for DNA transfer experiments with higher eucaryotic cells. *Mol Cell Biol* 4:2929-2931.

Bourouis & Jarry (1983) Vectors containing a prokaryotic dihydrofolate reductase gene transform *Drosophila* cells to methotrexate-resistance. *EMBO J* 2:1099-1104.

Braun & Schmitz (1999) The protein-import apparatus of plant nuclear. *PLANTA* 209:267-274.

Brookes (1994) The essence of SNPs. *Gene* 234:177-186.

Bustos et al. (1989) Regulation of beta-glucuronidase expression in transgenic tobacco plants by an A/T-rich, cis-acting sequence found upstream of a French bean beta-phaseolin gene. *Plant Cell* 1:839-854.

Callis et al. (1987) Introns increase gene expression in cultured maize cells. *Genes Develop* 1:1183-1200.

Castle et al. (2004) Discovery and directed evolution of a glyphosate tolerance gene. *Science* 304:1151-1154.

Chalyk, S. T., 1994 Properties of maternal haploid maize plants and potential application to maize breeding. *Euphytica* 79: 13-18.

Chalyk, S. T., A. Baumann, G. Daniel, and J. Eder, 2003 Aneuploidy as a possible cause of haploid-induction in maize. *Maize Genet. Newsl.* 77: 29-30.

Chang, M., and E. H. Coe, 2009 Doubled haploids, pp. 127-142 in Molecular Genetic Approaches to Maize Improvement, edited by A. L. Kritz and B. Larkins. Springer-Verlag, Berlin.

Chase (2007) Haploid induction: a window to the world of plant 1—nuclear interactions. *Trends in Genetics* 23:81-90.

Chase, S. S., 1952 Monoploids in maize, pp. 389-399 in Heterosis, edited by J. W. Gowen. Iowa State College Press, Ames, IA.

Chen et al. (2003) Temporal and spatial control of gene silencing in transgenic plants by inducible expression of double-stranded RNA. *Plant J* 36:731-740.

Choi et al. (1995) Tissue-specific and developmental regulation of a gene encoding a low molecular weight sulfur-rich protein in soybean seeds. *Mol Gen Genet* 246:266-268.

Christensen et al. (1989) Sequence analysis and transcriptional regulation by heat shock of polyubiquitin transcripts from maize. *Plant Mol Biol* 12:619-632.

Christensen et al. (1992) Maize polyubiquitin genes: structure, thermal perturbation of expression and transcript splicing, and promoter activity following transfer to protoplasts by electroporation. *Plant Mol Biol* 18:675-689.

Christou et al. (1991) Production of Transgenic Rice (*Oryza Sativa* L.) plants from agronomically important Indica and *Japonica* varieties via electric discharge particle acceleration of exogenous DNA into immature zygotic embryos. *Nature Biotechnol* 9:957-962.

Coe, E. H., 1959 A line of maize with high haploid frequency. *Am. Nat.* 93: 381-382.

Conceicao et al. (1994) A cotyledon regulatory region is responsible for the different spatial expression patterns of *Arabidopsis* 2S albumin genes. *Plant* 5:493-505.

Dasgupta et al. (1993) Cloning and sequencing of 5′ flanking sequence from the gene encoding 2S storage protein, from two *Brassica* species. *Gene* 133:301-302.

Datta et al. (1990) Genetically engineered fertile Indica-rice recovered from protoplasts. *Nature Biotechnol* 8:736-740.

Deimling, S., F. K. Riker, and H. H. Geiger, 1997 Methodology and genetics of in vivo haploid induction in maize. Vortr. Pflanzenzüchtg. 38: 203-224.

Della-Cioppa et al. (1987) Protein trafficking in plant cells. *Plant Physiol* 84:965-968.

Dong et al. (1996) Characterization of rice transformed via an *Agrobacterium*-mediated inflorescence approach. *Molecular Breeding* 2:267-276.

Dong et al. (2013) Fine mapping of qhir1 influencing in vivo haploid induction in maize. Theor. Appl. Genet 126: 1713-1720.

Dunwell J M. 2010. Haploids in flowering plants: origins and exploitation. *Plant Biotechnology Journal* 8, 377-424.

Eldar, A., V. K. Chary, P. Xenopoulos, M. E. Fontes, O. C. Losón et al., 2009 Partial penetrance facilitates developmental evolution in bacteria. Nature 460: 510-514.

Elroy-Stein et al. (1989) Cap-independent translation of mRNA conferred by encephalomyocarditis virus 5' sequence improves the performance of the vaccinia virus/bacteriophage T7 hybrid expression system. *Proc Natl Acad Sci USA* 86:6126-6130.

Estruch et al. (1994) Cloning and characterization of a maize pollen-specific calcium-dependent calmodulin-independent protein kinase. *Proc Natl Acad Sci USA* 91:8837-8841.

European Patent Applications EP 0 292 435; EP 0 332 581; EP 0 392 225.

Evans M M S. 2007. The indeterminate gametophyte 1 gene of maize encodes a LOB domain protein required for embryo sac and leaf development. *The Plant Cell* 19, 46-62.

Fey & Maréchal-Drouard (1999) Compilation and analysis of plant nuclearly promoter sequences: An illustration of a divergent evolution between monocot and dicot nuclear. *Biochem Biophys Res Commun* 256:409-414.

Fiume et al. (2004) Introns are key regulatory elements of rice tubulin expression. *Planta* 218: 693-703.

Fischer E. 2004. Molecular genetic studies on the occurrence of paternal DNA transmission during in vivo haploid induction in maize (*Zea mays*) [in German]. Dissertation, University of Hohenheim.

Fromm et al. (1990) Inheritance and expression of chimeric genes in the progeny of transgenic maize plants. *Nature Biotechnol* 8:833-839.

Gallie et al. (1987) A comparison of eukaryotic viral 5'-leader sequences as enhancers of mRNA expression in vivo. *Nucl Acids Res* 15:8693-8711.

Gallie et al. (1989) Eukaryotic viral 5'-leader sequences act as translational enhancers in eukaryotes and prokaryotes. In: *Molecular Biology of RNA*, Cech (ed.). UCLA Symposia on Molecular and Cellular Biology, New Series, Alan R. Liss, Inc., New York, New York, Volume 92, pp. 237-256.

Geiger, H. H., 2009 Doubled haploids, pp. 641-657 in Maize Handbook, Vol. 2, edited by J. L. Bennetzen, and S. Hake. Springer, New York.

GENBANK® Accession Nos. EF115541; NC_007579.

GENBANK® Accession Nos. J02798; J05212; L05934; M63985; NC_003377; U09118; U09119; U39944; U43147; U45855; U93215; X15596; X74782; YP_398418; YP_398423; Z17657.

Gordon-Kamm et al. (1990) Transformation of maize cells and regeneration of fertile transgenic plants. *Plant Cell* 2:603-618.

Green et al. (1988) Binding site requirements for pea nuclear protein factor GT-1 correlate with sequences required for light-dependent transcriptional activation of the rbcS-3A gene. *EMBO J* 7:4035-4044.

Guo et al. (2003) A chemical-regulated inducible RNAi system in plants. *Plant J* 34:383-392.

Hanson & Bentolila (2004) Interactions of nuclearly and nuclear genes that affect male gametophyte development. *Plant Cell* 16 Suppl: S154-169

Hedgcoth et al. (2002) A chimeric open reading frame associated with haploid induction in alloplasmic wheat with *Triticum timopheevi* nuclear is present in several *Triticum* and *Aegilops* species, maize, and rye. *Curr Genet* 41:357-365.

Hiei et al. (1994) Efficient transformation of rice (*Oryza sativa* L.) mediated by *Agrobacterium* and sequence analysis of the boundaries of the T-DNA. *Plant J* 6:271-282.

Hiei et al. (1997) Transformation of rice mediated by *Agrobacterium tumefaciens*. *Plant Mol Biol* 35:205-218.

Hill & Robertson (1968) Linkage disequilibrium in finite populations. Theor. Appl. Genet. 38, 226-231. *Theor Appl Genet* 38:226-231.

Hofgen & Willmitzer (1988) Storage of competent cells for *Agrobacterium* transformation. *Nucl Acids Res* 16:9877.

Huang et al. (1996) The *Arabidopsis* ACT11 actin gene is strongly expressed in tissues of the emerging inflorescence, pollen, and developing ovules. *Plant Mol Biol* 33:125-139.

Huang et al. (2009) Refining the Definition of Plant Nuclearly Presequences through Analysis of Sorting Signals, N-Terminal Modifications, and Cleavage Molifs. *Plant Physiol* 150:1272-128.

Japanese Patent Application JP 2001512988-A/13.

Jing et al. (2012) A male sterility-associated cytotoxic protein ORF288 in *Brassica juncea* causes aborted pollen development. *J Exp Biol* 63:1285-1295.

Jobling & Gehrke (1987) Enhanced translation of chimaeric messenger RNAs containing a plant viral untranslated leader sequence. *Nature* 325:622-625.

Jordano et al. (1989) A sunflower helianthinin gene upstream sequence ensemble contains an enhancer and sites of nuclear protein interaction. *Plant Cell* 1:855-866.

Josefsson et al. (1987) Structure of a gene encoding the 1.7 S storage protein, napin, from *Brassica napus*. *J Biol Chem* 262:12196-1201.

Kalendar et al. (1999) TRAP and REMAP: two new retrotransposon-based DNA fingerprinting techniques. *Theor Appl Genet* 98:704-.

Kermicle J L. 1969. Androgenesis conditioned by a mutation in maize. *Science* 166, 1422-1424.

Klein et al. (1987) High-velocity microprojectiles for delivering nucleic acids into living cells. *Nature* 327:70-73.

Koziel et al. (1993) Field performance of elite transgenic maize plants expressing an insecticidal protein derived from *Bacillus thuringiensis*. *Nature Biotechnol* 11:194-200.

Lashermes, P., and M. Beckert, 1988 Genetic control of maternal haploidy in maize (*Zea mays* L.) and selection of haploid inducing lines. Theor. Appl. Genet. 76: 405-410.

Last et al. (1991) Emu: an improved promoter for gene expression in cereal cells. *Theor Appl Genet* 81:581-588.

Lee & Gelvin (2008) T-DNA Binary vectors and systems. *Plant Physiol* 146:325-332.

Lee & Huang (1994) Genes encoding oleosins in maize kernel of inbreds Mo17 and B73. Plant *Mol Biol* 26:1981-1987.

Lee et al. (2007) Novel Plant Transformation Vectors Containing the Superpromoter. *Plant Physiol* 1294-1300.

Lommel et al. (1991) Identification of the maize chlorotic mottle virus capsid protein cistron and characterization of its subgenomic messenger RNA. *Virology* 181:382-385.

Lu et al. (2008) Activity of the 5' regulatory regions of the rice polyubiquitin rubi3 gene in transgenic rice plants as analyzed by both GUS and GFP reporter genes. *Plant Cell Rep* 27:1587-600.

Li L, Xu X, Jin W, Chen S. 2009. Morphological and molecular evidences for DNA introgression in haploid induction via a high oil inducer CAUHOI in maize. *Planta* 230, 367-376.

Macejak & Sarnow (1991) Internal initiation of translation mediated by the 5' leader of a cellular mRNA. *Nature* 353:90-94.

Manjunath et al. (1997) Molecular characterization and promoter analysis of the maize cytosolic glyceraldehyde 3-phosphate dehydrogenase gene family and its expression during anoxia. *Plant Mol Biol* 33:97-112.

Martinez et al. (1989) Structure, evolution and anaerobic regulation of a nuclear gene encoding cytosolic glyceraldehyde-3-phosphate dehydrogenase from maize. *J Mol Biol* 208:551-565.

Mayo (1987) *The Theory of Plant Breeding, Second Edition*, Clarendon Press, Oxford, United Kingdom.

McBride et al. (1994) Controlled expression of plastid transgenes in plants based on a nuclear DNA-encoded and plastid-targeted T7 RNA polymerase. *Proc Natl Acad Sci USA* 91:7301-7305.

McElroy et al. (1990) Isolation of an efficient actin promoter for use in rice transformation. *Plant Cell* 2:163-171.

Meier et al. (1991) Elicitor-inducible and constitutive in Vivo DNA footprints indicate novel cis-acting elements in the promoter of a parsley gene encoding pathogenesis-related protein 1. *Plant Cell* 3:309-316.

Mettler (1987) A simple and rapid method for miniprepation of DNA from tissue cultured plant cells. *Plant Mol Biol Reporter* 5:346-349.

Murashige & Skoog (1962) A revised medium for rapid growth and bioassays with tobacco tissue cultures. *Physiologia Plantarum* 15:473-497.

Nanda, D. K., and S. S. Chase, 1966 An embryo marker for detecting monoploids of maize (*Zea mays* L.). Crop Sci. 6: 213-215.

Needleman & Wunsch (1970) A general method applicable to the search for similarities in the amino acid sequence of two proteins. *J Mol Biol* 48:443-453.

Negrotto et al. (2000) The use of phosphomannose-isomerase as a selectable marker to recover transgenic maize plants (*Zea mays* L.) via *Agrobacterium* transformation. *Plant Cell Reports* 19:798-803.

Neuffer M G, Sheridan W F. 1980. Defective kernel mutants of maize. I. Genetic and lethality studies. *Genetics* 95, 929-944.

Ni et al. (1995) Strength and tissue specificity of chimeric promoters derived from the octopine and mannopine synthase genes. *Plant J* 7:661-676.

Odell et al. (1985) Identification of DNA sequences required for activity of the cauliflower mosaic virus 35S promoter. *Nature* 313:810-812.

Onozaki et al. (2004) A RAPD-derived STS marker is linked to a bacterial wilt (*Burkholderia caryophylli*) resistance gene in carnation. *Euphytica* 138:255-262.

Orita et al. (1989) Detection of polymorphisms of human DNA by gel electrophoresis as single-strand conformation polymorphisms. *Proc Natl Acad Sci USA* 86:2766-.

Paran & Michelmore (1993) Development of reliable PCR-based markers linked to downy mildew resistance genes in lettuce. *Theor Appl Genet* 85:985-993.

Paszkowski et al. (1984) Direct gene transfer to plants. *EMBO J* 3:2717-2722.

PCT International Patent Application Publication Nos. WO 1992/013957; WO 1993/07278; WO 1993/21335; WO 1994/00977; WO 1997/32011; WO 1999/043838.

Pearson & Lipman (1988) Improved tools for biological sequence comparison. *Proc Natl Acad Sci USA* 85:2444-2448.

Potrykus et al. (1985) Molecular and general genetics of a hybrid foreign gene introduced into tobacco by direct gene transfer. *Mol Gen Genet* 199:169-177.

Prigge V, Melchinger A E. 2012. Production of haploids and doubled haploids in maize. *Methods in Molecular Biology* 877, 161-172.

Prigge, V., and A. E. Melchinger, 2012 Production of haploids and doubled haploids in maize, Plant Cell Culture Protocols, Ed. 3, edited by V. M. Loyola-Vargas and N. Ochoa-Alejo. Humana Press-Springer Verlag, Totowa, NJ (in press).

Prigge, V., C. Sanchez, B. S. Dhillon, W. Schipprack, J. L. Araus et al., 2011 Doubled haploids in tropical maize. I. Effects of inducers and source germplasm on in vivo haploid induction rates. Crop Sci. 51: 1498-1506.

Prigge V, Xu X, Li L, Babu R, Chen S, Atlin G N, Melchinger A E. 2012. New insights into the genetics of in vivo induction of maternal haploids, the backbone of doubled haploid technology in maize. *Genetics* 190, 781-793.

Rafalski & Tingey (1993) Genetic diagnostics in plant breeding: RAPDs, microsatellites and machines. *Trends Genet* 9:275-280.

Ravi, M., and S. W. L. Chan, 2010 Haploid plants produced by centromere-mediated genome elimination. Nature 464: 615-619

Reed et al. (2001) Phosphomannose isomerase: an efficient selectable marker for plant transformation. In *Vitro Cell Dev Biol-Plant* 37:127-132.

Reich et al. (1986) Efficient transformation of alfalfa protoplasts by the intranuclear microinjection of Ti plasmids. Nature *Biotechnol* 4:1001-1004.

Reiser et al. (1995) he BELL1 Gene Encodes a Homeodomain Protein Involved in Pattern Formation in the *Arabidopsis* Ovule Primordium. *Cell* 83:735-742.

Riker, F. K., G. A. Gordillo, and H. H. Geiger, 2005 In vivo haploid induction in maize: performance of new inducers and significance for doubled haploid lines in hybrid breeding. Maydica 50: 275-283

Roque et al. (2007) The PsEND1 promoter: a novel tool to produce genetically engineered male-sterile plants by early anther ablation. *Plant Cell Reports* 26:313-325.

Sambrook & Russell (2001) *Molecular Cloning: A Laboratory Manual* (3rd ed.), Cold Spring Harbor Library Press, Cold Spring Harbor, New York, United States of America.

Sarkar K, Coe E. 1966. A genetic analysis of the origin of maternal haploids in maize. *Genetics* 54, 453-464.

Schocher et al. (1986) Co-transformation of unlinked foreign genes into plants by direct gene transfer. *Nature Biotechnol* 4:1093-1096.

Sheridan et al. (1996) The mac 1 Gene: Controlling the Commitment to the Meiotic Pathway in Maize. *Genetics* 142:1009-1020.

Shimamoto et al. (1989) Fertile transgenic rice plants regenerated from transformed protoplasts. *Nature* 338:274-276.

Singh, (1986) *Breeding for Resistance to Diseases and Insect Pests*, Springer-Verlag, New York, New York, United States of America.

Sjodahl et al. (1995) Deletion analysis of *Brassica napus* cruciferin gene cm 1 promoter in transformed tobacco: promoter activity during early and late stages of embryogenesis is influenced by cis-acting elements in partially separate regions. *Planta* 197:264-274.

Sjoling & Glaser (1998) Nuclear targeting peptides in plants. *Trends Plant Sci* 3:136-140.

Skuzeski et al. (1990) Analysis of leaky viral translation termination codons in vivo by transient expression of improved beta-glucuronidase vectors. *Plant Mol Biol* 15:65-79.

Smith & Waterman (1981) "Comparison of biosequences. *Adv Appl Math* 2: 482-489.

Solocombe et al. (1994) Temporal and tissue-specific regulation of a *Brassica napus* stearoyl-acyl carrier protein desaturase gene. *Plant Physiol* 104:1167-1176.

Song & Hedgcoth (1994) A chimeric gene (orf256) is expressed as protein only in cytoplasmic male-sterile lines of wheat. *Plant Mol Biol* 26:535-539.

Spencer et al. (1990) Bialaphos selection of stable transformants from maize cell cultures. *Theor Appl Genet* 79:625-631.

Svab & Maliga, (1993) High-frequency plastid transformation in tobacco by selection for a chimeric aadA gene. *Proc Natl Acad Sci USA* 90:913-917.

Svab et al. (1990) Stable transformation of plastids in higher plants. *Proc Natl Acad Sci USA* 87:8526-8530.

Tsuchiya et al. (1994) Molecular characterization of rice genes specifically expressed in the anther tapetum. *Plant Mol Biol* 26:1737-1746.

U.S. Patent Application Publication Nos. 2005/0060767; 2005/0246798; 2006/0260011; 2007/0004912; 2007/0006344; 2010/0205692; 2012/0021506; 2012/0036593.

U.S. Pat. Nos. 4,945,050; 4,940,935; 5,036,006; 5,100,792; 5,188,642; 5,268,463; 5,276,268; 5,399,680; 5,466,785; 5,569,597; 5,561,236; 5,589,610; 5,591,616; 5,604,121; 5,608,142; 5,608,144; 5,608,149; 5,639,948; 5,641,876; 5,659,026; 5,767,378; 5,994,629; 6,072,050; 6,177,611; 7,151,201; 7,166,770; 7,253,340; 7,550,578; 8,168,859.

Uknes et al. (1993) Regulation of pathogenesis-related protein-la gene expression in tobacco. *Plant Cell* 5:159-169.

Urao et al. (1996) Molecular cloning and characterization of a gene that encodes a MYC-related protein in *Arabidopsis*. *Plant Mol Biol* 32:571-576.

Vasil et al. (1992) Herbicide resistant fertile transgenic wheat plants obtained by microprojectile bombardment of regenerable embryogenic callus. *Nature Biotechnol* 10:667-674.

Vasil et al. (1993) Rapid production of transgenic wheat plants by direct bombardment of cultured immature embryos. *Nature Biotechnol* 11:1553-1558.

Velten et al. (1984) Isolation of a dual plant promoter fragment from the Ti plasmid of *Agrobacterium tumefaciens*. *EMBO J* 3:2723-2730.

Viera & Messing (1982) The pUC plasmids, an M13mp7-derived system for insertion mutagenesis and sequencing with synthetic universal primers. *Gene* 19:259-268.

Vos et al. (1995) AFLP: a new technique for DNA fingerprinting. *Nucleic Acids Res* 23:4407-4414.

Weeks et al. (1993) Rapid production of multiple independent lines of fertile transgenic wheat (*Triticum aestivum*). *Plant Physiol* 102:1077-1084.

Wei et al. (2003) Comparative expression analysis of two sugarcane polyubiquitin promoters and flanking sequences in transgenic plants. *J Plant Physiol* 160:1241-1251.

Welsh (1981) *Fundamentals of Plant Genetics and Breeding*, John Wiley & Sons, New York, New York, United States of America.

White et al. (1990) A cassette containing the bar gene of *S. hygroscopicus*: a selectable marker for plant transformation. *Nucl Acids Res* 18:1062.

Wood (ed) (1983) *Crop Breeding*, American Society of Agronomy, Madison, Wisconsin, United States of America.

Wricke & Weber (1986) *Quantitative Genetics and Selection Plant Breeding*, Walter de Gruyter and Co., Berlin, Germany.

Yang et al. (2010) Nuclearly-targeted expression of a haploid induction-associated orf220 gene causes male sterility in *Brassica juncea*. *BMC Plant Biol* 10:231.

Zhang & Glaser (2002) Interaction of plant nuclearly and chloroplast signal peptides with the Hsp70 molecular chaperone. *Trends Plant Sci* 7:14-21.

Zhang, Z. L., F. Z. Qiu, Y. Z. Liu, K. J. Ma, Z. Y. Li et al., 2008 Chromosome elimination and in vivo haploid induction by stock 6-derived inducer line in maize (*Zea mays* L.). Plant Cell Rep. 27: 1851-1860.

Zhang et al. (1988) Transgenic rice plants produced by electroporation-mediated plasmid uptake into protoplasts. *Plant Cell Rep* 7:379-384.

Zhang et al. (1996) DNA sequences that activate isocitrate lyase gene expression during late embryogenesis and during postgerminative growth. *Plant Physiol* 110:1069-1079.

Zhong et al. (1996) The circadian clock gates expression of two *Arabidopsis* catalase genes to distinct and opposite circadian phases. *Mol Gen Genet* 251:196-203.

It will be understood that various details of the presently disclosed subject matter may be changed without departing from the scope of the presently disclosed subject matter. Furthermore, the foregoing description is for the purpose of illustration only, and not for the purpose of limitation.

SEQUENCE LISTING (144 sequences)

SEQ ID NO: 1 - DNA, 1302 bp, Zea mays
cccgctacctgttcaccgcgcgccagcgaaacctccgcacgcccactgcccatctgttccccgtgcgccagcgaaacatccgcacgcccgcggcccgcctgttccccgcgcatcccgctgcacgacttctgctaccgcaacggccacccacgcacgcccgcctgttcaccgcgcatcccgctgacctccccttcacgctcgcacacgctccgttcccccaccccaccgcaatccccgacgaactcattaccagtagaatcagttactaactgcttttctttttcttggattagaatggctggggctatctctcaccatgcgctagcattttcacaatcccactggtgcagtgcgaagaactctagattcggaaagaggacgggcaatgctcgcctggtttatctaaaaggaagatgtggttcaggcagcagaaaactgggtttgatgtgggcctcgagctcgcagtcttctgtcatggagccgacgcacctaccatctgatggcaacagcagccacaccccaaaaaaatcaagtgaaagcgctcttatattgatttggcatggtgaatccctgtggaacgagaaaaatctatttcctggctgcatcgatgtacccctgacaccgaagggtgttgaggaggccattgaggcaggtaaaaggatatgcaatatcccaatcgatgtgatatatacttcatcactgatttgtgctcagatgaccgcaatgcttgccatgatgcagcatcgacgcaagaagatcctagttatcacgcataatgagagtgaacaagctcacaggtggagtcagatatacagtgaggagacaatgaaacagtccattcctgtcatcacagcttggcaattgaatgaacggatgtatggtgagctacaaggccttaacaagcaagaaactgtagatcgatttggcaaagaacaagttcatgagtggcgccgcagttatgatattcctccgccaaatggagaaagtctagagaagtgtgctgagagagctgttgcttatttcaaagatcagattattccacaacttgtggctggaaaacatgtgatggttgctgcacatgggaattcacttcgttcaattataatgcatctggacaaattaacttctcagaaggtaataagccttgagctgtctactggcattcccatgctttacatattcaaagagggaaagtttattcgacgtgggactccagtaggaccttcggaggccagtgtttatgcttataccaggaccaaacgatttgctgagcacattacatttcagaacaaattggcctag

SEQ ID NO: 2 - protein, 335 aa, Zea mays
MAGAISHHALAFSQSHWCSAKNSRFGKRTGNARLVYLKGRCGSGSRKLGLMWASSSQSSVMEPTHLPSDGNSSHTPKKSSESALILIWHGESLWNEKNLFPGCIDVPLTPKGVEEAIEAGKRICNIPIDVIYTSSLICAQMTAMLAMMQHRRKKILVITHNESEQAHRWSQIYSEETMKQSIPVITAWQLNERMYGELQGLNKQETVDRFGKEQVHEWRRSYDIPPPNGESLEKCAERAVAYFKDQIIPQLVAGKHVMVAAHGNSLRSIIMHLDKLTSQKVISLELSTGIPMLYIFKEGKFIRRGTPVGPSEASVYAYTRTKRFAEHITFQNKLA

SEQ ID NO: 3 - DNA, 2992 bp, Zea mays
ttcaaccaccaaaatcaattaggaaaaggtgtaagcctatttccctttcaggaggcgtacgtgagagggagaggtgaaaaggaacaacgcgtataccagataaggtcccacagcctaagtaggtagccttctgatatctctactaactattaaggagagagtgtagactgcccccgctccctacccaacgccccccgctacctgttcaccgcgcgccagcgaaacctccgcacgcccactgcccatctgttccccgtgcgccagcgaaacatccgcacgcccgcggcccgcctgttccccgcgcatcccgctgcacgacttctgctaccgcaacggccacccccgcacgcccgcctgttcaccgcgcatcccgctgacctccccttcacgctcgcacacgctccgttcccccaccccaccgcaatccccgacgctataagagcggtaaccaactccatctccctggtgccacgcattgttgagttcttaaggtgcgtttcgttgaggacttgttcatttttgttggtcatgtattccattttactgctctaccattttgtggaataaagggaggaatgttttcactagaagagttcatcaatcttatgttggtttcttggatcagttttgctctatggctaaatggtcgaattgagcctatttcattataaagttagcgagcgaataattgttcagcctcttcctagaactcattaccagtagaatcagttactaactgcttttctttttcttggattagaatggctggggctatctctcaccatgcgctagcattttcacaatcccactggtgcagtgcgaagaactctagattcggaaagaggacgggcaatgctcgcctggtttatctaaaaggaagatgtggttcaggcagcagaaaactgggtttgatgtgggcctcgagctcgcagtcttctgtcatggagccgacgcacctaccatctgatggcaacagcagccacaccccaaaaaaatcaagtaattttaacgacctcctatggtggttatttgtttttaatttgagaaaactatccatttgacacatttaactttgggcttctcagaatttggggcatataataagatctgctaatctgttatctctatgtcgttgtaggtgaaagcgctcttatattgatttggcatggtgaatccctgtggaacgagaaaaatctatttactggctgcatcgatgtacccctgacaccgaagggtgttgaggaggccattgaggcaggtaaaaggatatgcaatatcccaatcgatgtgatatatacttcatcactgatttgtgctcagatgaccgcaatgcttgccatgatgcagcatcgacgcaagaaggtttgtgtctttcctttgaaattccagtaatttcttctagcatttgtatgaacttgccggagaaatcatgctttgctggtgatatatgtatttatagatcccagttatcacgcataatgagagtgaacaagctcacaggtggagtcagatatacagtgaggagacaatgaaacagtccattcctgtcatcacagcttggcaattgaatgaacggatgtaatactttctccatactctttgatttgctaattactccctctgtctcaaaatagtattaattttagctcttgatttttatgtctatattcaaatagatgatgataaatctagattctagacacaaatataaaacatatacatcaagtattatatgaatctattaatttactaagaccaattttaatttgggacagagggagtatacgattataatagttgtttgactgtgcttctctttaaatatcccttgacatttctaggtatggtgagctacaaggccttaacaagcaagaaactgtagatcgatttggcaaagaacaagttcatgagtggcaccgcagttatgatattcctccgccaaatggagaaagtctagagaagtgtgctgagagagctgttgcttatttcaaagatcaggcacatctagcaaggccactttacactaattgaaagatacactttttacttgggttattggtcttgctgcagtattggtatgcatgctaaaggttattcttgaatcgatgaattcctctactatgggatgcagaaatgcatgtgcttagttttctttctattgtgctagctcatatcaaatttataacctgaattttttatttatgttcgactctaaaaaacagttttttctagctcgatttgacctatagtaatttttccgtaatagattattccacaacttgtggctggaaaacatgtgatggttgctgcacatgggaattcacttcgttcaattataatgcatctggacaaattaacttctcagaaggtaattcactgtcgtttttgtctttccatcaaaaaggactcggctaaacagaacatgtagcattatgttaagtttgggagtgagcctttcgtcccttcaggtaataagccttgagctgtctactggcattcccatgctttacatattcaaagagggaaagtttattcgacgtgggactccagtaggaccttcggaggccagtgtttatgcttataccagggtaagattctttcccccacatgttctaccataggacgatactccagtttacaaaccttatctgtacagaccaaacgatttgctgagcacattacatttcagaacaaattggcctagaagataaggggtgtttggtttgagaaatcactctattcaaaatgagatggtgtatcatgggtccatttctcaaatttggtgggatgaccctattcctcatattagtactaactaggtgagtgtccgtgcgttgcaacgggaacatataataacatgataacttatatacaaaatgtgtcttatattgttataagaaaatgtttcataatctatttgtgatcctggccatacataaattttgttattttaatttaactgtttcactactacattgaaatcatcagtatc

SEQ ID NO: 4 - DNA, 6916 bp, Artificial Sequence
  Synthetic
cctcgggacccttgtcgcgttgttcgttccattgccgcatcacctcctttctcatcgtgcattacgaggtcttcaaagggcttttggtcatcagccgggagcgcctccatcgccggcttgatgatgttggtagtggagatcttggtgtgatccttaaaaccggccatttatgggccgatttttagcagatctagacacctattccccagcggagtcgccaaaagtatgttgacgctttttcggagcgccaatcactcaagaagaaccggcggcggtgccctctgcacaggggcggacgctccgcgcgcaggggccggacgctccgcggcctggtgcgaggcggcggcgctctctggttagacgcggacggtgcgcggcacagggccggacggtgcgcgacctagtgcaggagcacgggttccctgcctgacggccggacgctccgcgctctagggccggacggtgcgcgcgtgcgcaggggcggcggaagatcgccggcggcgcctggatctcgctcccgggagggagcccgtcggggaggagagatcctaggagttgtctaggctcgggccggccgacctagactcctctaatcgacgtagagtcgaggagaggcagagaatttggggattggaatactaaactagggctaaactagaactagactagaactactcctaattgtgctgaaaataaatgcgagatagaagttgtattggttcgattgttgggggtcaatcggccgtagcccttcatctatataaaggggaggtctggatccgtttccaactgatttccgagttaatcccgcggttttaggtaacaaatcccgcgagaaactaggaaccctaactgactctgcgcacgcgccgaccgtccgcgccaccaccgcggacggtcccgaccgcggagcgtccggcctccgggccggagcgtccgcacggtcattttgggttcgaacagagtcccaacgaggttagtaaatgtagtgatgaaattaagttttgtacgaagtttgtaaatttaaggacctgttttacataactattggagaagagttttctctgaaaaattcttaaatttatatttagggagttgtttatataactattggcatttgagatgctctaaggaagcgaaggaaataacttggcggcgatcctagtcgacaaccgttgaattcgtgagaatcaatcattctgtaggagtaaaaaaataaaataaaatatgcatttcctcgttcctatacgcttaaattagacgaccctggactggaaccaggaactaggaaggggcaccgatgtcatttgcgaagcaacaacaacatgcgtgaggacgaccaagtcaaacgttgcgtcgcgttgcctcgccggcgggccggtcccaccaagacgtggcgccatgcaagtgcgtcgtcgaccctcttctctctctctcttgtagtcttgttcctgttatctctctcggctgtccgctgccccgtgatctgagcgcgtttctctcccgtcctctcttctccctctcccgcaacaaacacctgctatccggtctccctctcccctgccatctctctctagcgcattgctagcgcgagcgcagaaggcacacacgtagagccttggtgatacctcctcctcctcctcctcctcctcctgatctcctctcctcctccggcctccgtatacctataactaaaagatgatcatcgtgcgatgcaggcgaactcgtcgtccgaaaaccatggatccaactcattaccagtagaatcagttactaactgcttttctttttcttggattagaatggctggggctatctctcaccatgcgctagcattttcacaatcccactggtgcagtgcgaagaactctagattcggaaagaggacgggcaatgctcgcctggtttatctaaaaggaagatgtggttcaggcagcagaaaactgggtttgatgtgggcctcgtgctcgcagtcttctgtcatggagccgacgcacctaccatctgatggcaacagcagccacaccccaaaaaaatcaagtgaaagcgctcttatattgatttggcatggtgaatccctgtggaacgagaaaaatctatttcctggctgcatcgatgtacccctgacaccgaagggtgttgaggaggccattgaggcaggtaaaaggatatgcaatatcccaatcgatgtgatatatacttcatcactgatttgtgctcagatgaccgcaatgcttgccatgatgcactcgagaaatctgaagaagagacatcagtaggaaaaccatgaaacaactcaccaagtgataaaactttgataaattcattcaaaagtatcatgttctacgtgattcgcttgtatgccaaattatctaaatattagtaagaattaactactcggacgatcatcagcaaatgaaaatgaaacagcacaccaattgagactgatcagatcagaaaccagaaaaacatctcaacatggataaattcatcagcaatactgtagcattgatatatttgtgtttcttgaaagaaagacatcaaagaaactttgcaattatgtagtattgtttatttttctgttacaaacttaatcaactgacatgtaatgtgtctctattgtcagttcaagtattagactatccattgtcaccttttaaatgtacctttactgtcagcgtacgagataaagttggccgattgaattctaagctactataaaagcaactttattatatagacatggcaaacaatcgttaacaaactgtttttctttttgattgattaggacttggaaacacactgaacatgatcaaagtcacaaaagtcacttggttgcctagtctgacagcaagcgcaggtgtaaattcagaatgatagtgaaccaaaactcatctgcttccagtaccaaattcgtcagaaggcagaacggaggcataagcacaaagggcatgctcacccgagtcgagtgcatcatggcaagcattgcggtcatctgagcacaaatcagtgatgaagtatatatcacatcgattgggatattgcatatccttttacctgcctcaatggcctcctcaacacccttcggtgtcaggggtacatcgatgcagccaggaaatagatttttctcgttccacagggattcaccatgccaaatcaatataagagcgctttcacttgatttttttggggtgtggctgctgttgccatcagatggtaggtgcgtcggctccatgacagaagactgcgagcacgaggcccacatcaaacccagttttctgctgcctgaaccacatcttccttttagataaaccaggcgagcattgcccgtcctctttccgaatctagagttcttcgcactgcaccagtgggattgtgaaaatgctagcgcatggtgagagatagccccagccattctaatccaagaaaaagaaaagcagttagtaactgattctactggtaatgagttggatctccatgggagctctcgtcatcgtcctactatcaagcaacacgatcgaccaccacctcgattatatatgcatcattatagtatcgtttattaatttcagacccacccactgctaaccacatcgtccacgagagattatattcatccgtggactacgctctcgatcttacaatttgaaacctttctattttcctaattactatgtattccaggttcattttgattgtgaccattcttcagttctttctgtaaggatcggagcatattatatactctatgtggctatgccaattatattgttgggtataagaatgcattttgtttctgtaatacggaaaaatatattttctttaagcaacaacaaggtaaaaacttgcctcgttgcatattttctttatgtcaatctccttttgttcgttgtatgatcctctgtttggaaactgaatactgatcgaacaactgatcaggagttaaaacatattgtaaatatatataaaaacttgctgtgtacaactcttctttattgtataagtttcttgaggtaaccgaaatagatagtaaatcccaatacaaatagattcctccgttactaactaatctgaacataaatgctaataaaaaaagtataaatttctatctgcgtatgtaccttgaccttacctttattctattaactcctgattttctattcagattttgaacggtctgttacttcctttctattctgttctggtttcgtcgtcgtttgtttccgaacggtctgctacttctgattttctatttgttcttacgtttggttttgccgttctagtttcttgcgtttttccatataaatatagaaacacaaaataaatgtaatgttgtagatacttgaactatcgatcttttcctttaaaaaatgatattgctaccactaatgtagttttaattaggaacaaaacttacaaccaatgatcaactaatgaaccggtctagaacagtctatatggacatggtgagcaagcgtacgtaattccggaccgcgcgggcggccgcactagtcccgggcccatcgatgatatcagatctggttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttaacctggcttatcgaaattaatacgactcactatagggagaccgg

SEQ ID NO: 5 - protein, 335 aa, Zea mays
MAGAISHHALAFSQSHWCSAKNSRFGKRTGNARLVYLKGRCGSGSRKLGLMWASSSQSSVMEPTHLPSDGNSSHTPKKSSESALILIWHGESLWNEKNLFTGCIDVPLTPKGVEEAIEAGKRICNIPIDVIYTSSLICAQMTAMLAMMQHRRKKIPVITHNESEQAHRWSQIYSEETMKQSIPVITAWQLNERMYGELQGLNKQETVDRFGKEQVHEWHRSYDIPPPNGESLEKCAERAVAYFKDQIIPQLVAGKHVMVAAHGNSLRSIIMHLDKLTSQKVISLELSTGIPMLYIFKEGKFIRRGTPVGPSEASVYAYTRTKRFAEHITFQNKLA

SEQ ID NO: 6 - protein, 335 aa, Zea mays
MAGAISHHALAFSQSHWCSAKNSRFGKRTGNARLVYLKGRCGSGSRKLGLMWASSSQSSVMEPTHLPSDGNSSHTPKKSSESALILIWHGESLWNEKNLFPGCIDVPLTPKGVEEAIEAGKRICNIPIDVIYTSSLICAQMTAMLAMMQHRRKKIPVITHNESEQAHRWSQIYSEETMKQSIPVITAWQLNERMYGELQGLNKQETVDRFGKEQVHEWHRSYDIPPPNGESLEKCAERAVAYFKDQIIPQLVAGKHVMVAAHGNSLRSIIMHLDKLTSQKVISLELSTGIPMLYIFKEGKFIRRGTPVGPSEASVYAYTRTKRFAEHITFQNKLA

SEQ ID NO: 7 - protein, 335 aa, Zea mays
MAGAISHHALAFSQSHWCSAKNSRFGKRTGNARLVYLKGRCGSGSRKLGLMWASSSQSSVMEPTHLPSDGNSSHTPKKSSESALILIWHGESLWNEKNLFTGCIDVPLTPKGVEEAIEAGKRICNIPIDVIYTSSLICAQMTSMLAMMQHRRKKIPVITHNESEQAHRWSQIYSEETMKQSIPVITAWQLNERMYGELQGLNKQETVDRFGKEQVHEWHRSYDIPPPNGESLEKCAERAVAYFKDQIIPQLVAGKHVMVAAHGNSLRSIIMHLDKLTSQKVISLELSTGIPMLYIFKEGKFIRRGTPVGPSEASVYAYTRTKRFAEHITFQNKLA

SEQ ID NO: 8 - protein, 335 aa, Zea mays
MAGAISHHALAFSQSHWCSAKNSRFGKRTGNARLVYLKGRCGSGSRKLGLMWASSSQSSVMEPTHLPSDGNSSHTPKKSSESALILIWHGESLWNEKNLFTGCIDVPLTPKGVEEAIEAGKRICNIPIDVIYTSSLICAQMTSMLAMMQHRRKKIPVITHNESEQAHRWSQIYSEETMKQSIPVITAWQLNERMYGELQGLNKQETVDRFGKEQVHEWRRSYDIPPPNGESLEKCAERAVAYFKDQIIPQLVAGKHVMVAAHGNSLRSIIMHLDKLTSQKVISLELSTGIPMLYIFKEGKFIRRGTPVGPSEASVYAYTRTKRFAEHITFQNKLA

SEQ ID NO: 9 - DNA, 4921 bp, Zea mays
attgctataagtataataatatctaagagatggaagaagactggccggccgggtagtgacaataatgaatgaccaacggcagaaaagttggtgcgaagatgttttaggtgaatgcaagtcacaaaaggaaaaggctggcatctcgaatagaactcctataccacggatcaagaaacaattaaaaccatacataattgtcggagtaatatgctaatcctagtaattttagtcacatcattggaggtccttcgttccattcaattttttttctttcttcatgaacatttgttcaagatttatctcccacatgtttcaaagcatgcattatttattattattggcaaatttcatgatctttcaaaagatatctcttgggcctggcatggatatgctctatctctagtaagtaattggctctgcaataatgagttggatattgccacgaagaaccacgccttgcttggaagaaacttgatgaatgccaaatcttgctctttttcaacatgttgatttaggaaattatttggcaaccaaacataatgtgactagaattagcacacttctaatgacaaaaatataatcacatttctgcgcgcacaaaatatttgcttgccaaaatgcaatcatgttttgatgtacagttcgatagacattgaaaaagaatgcatttaggaaccttttagtaccactttgatcaatttctgccatctacacgtcaaactagataaaaagaataatggcagccacatcctacagaaaaaaaaagacatatcaagaattcaacttaatttcagaatatacaagatttcatagtgacctttaacattgatttttcgactcacatcttataagcgggtgaagcagtatataaaagaattccacaaaaaaatctacaacagccataagcattaattacacataaacgctcaccaccctataaaacacccagaccttcacatttcttcttcagacctccaacaagcagcagatagatagagaaatgaagagatagattagagttaccatcatatccccaacaatggcatagccaacaagttggatccttcggaccctgtagctcctggtccatgaattgccaagagaacaccttttagtttctttgagcaacctcgatctcgccatggggttccgctgtggccgtgcctcctcttcgctgctgtgtgaagaggacgtggccggcatgtttggatgcaatgggcacgacgacgaagaggtggggcttctggtgttggggatggacacgacttttgctgcgctgccatcacagagcgacgaggtcgtagcatccctgatggagaaggagaaggagcagctgcatagcgttgcgacgggggattacctccagaggctgagcagtggaggactggagtcatcttgtaggattgccgccattgattggataaaaaaggtttctgcttctccatccatactatatagtatgtatatgatttctcgcgcatcgatcctagttagaatctcatgtttctgtgttttgcagcaaaatgcaatttatttgactccaagtttgacttaaacttcagtttgttcaaaaaaaaaaagtttgcccttgcttgaccaaaacctcgttttgcatatatagataaatatatagttactgaaatgtgtactacttgtctcttacatgtgtattaattgcaggcccaggcttatcacgactttggaccgttgtctgcttatcttgctgttaactaccttgatagggtcctctccacaaatcaagtcccagtgagttctacaaatgtacccaacttgtttattcttttttctacatgtccaatcagcatgtggttgtcagaggtctttgcctctccctctctagaaaaccttatggcatgtttggttcagcggcggaccaggaactaaagacagcctatgcgagattataagtgtcaataactatagctaatttcatataaaaaaatacatgcatatttggatttgagatgcactttcgtccgatcagtagataaggtcatttggtttaggatcatgagttgagttaggacttagcactattggaatcgagctctttgtcaattgtctgaagcactcggcaaagctgggaaaacactcgacgacgtctttgccgagtgtagcactcggcaaagagagctcggcgaacagtatatcgacacggcttctttgccgagtattttttatcgggcactcgacaaagactttgccgagtgtcactcggtactcggcaaagaaaagtcgccgtcaaggcgaccggaaacggagacagcgcctttgccgagtgttctaggtgacactcggcaaagagattacctttgtcgagtgtccgccagtctacactcgccaaaggggctaccagcggacccctttgtcagtttctttgccgagtgcgctagaaggcactcggcaaagcttgcttctttgtcgagtgccaaggccacagcactcggcaaataagctttaccggtgcccaggaatggcactcggcaaaatgttctttatcgagtgtcaggcgataggacactcggcaaagtagcttctttgccgaatgccaaagcctagcgttcggcatagataacagccgtcagctatagacggctgctgacggttctttgcctagcaccgaattgtgtcgagtgtttggcactcgacaaagtagtctttgccactactttgccgagtgtctttctgtgccgagagtcctattatcggcaaacgcgatcgttatcgagagtgaaactttgtcgagtgtggcactcggcaaagaagtgtcgagtgcccgataaaaaacacttggcaaagagccaaattccgatagcgtagcattcgtgcagccgtacgttagaattggacagacgagggatgtgactgtgctcggctgttccagctatatcctgcaaccaaacacaaccttacattttgatggggcacaaatcttatgtgagtttcttggtgtaggctgatgctgaccaccagccctggatgccacagctgctgtccgttgcttgcctaaccattgcagccaagatggaggagaccgtggttcctcgccgtctggacatccatcagaatcaggtggacaaaattggatatatagtacagtttcacgtttgagttcaccaaatctttatctttattatatatatatatatgtcacaggttctcagcgagaagtacagattcgatttagatgctattcagaggatggagatttacattctagactctctgaattggaggatgcaagctgtgacgccattctcttacatcaactatttcgtggacaagttcactgatgggaagccgctaagttgcggattcatttctcggtgcaccgagatcatacttggcagtcttgaaggtacatcagattacttcatgcatgagcgagcgaatcggacttacccgccttttccattcgataagcaattgttactatgtgattggaacatgcatctaaatagatgtctgtgtgcatttgatttgcagcaacgaagctcctacagttcaggccttctgagatggcagcagcagtggttctgtcagcagctgctgagtctcaagtcattgccttcagcggcgctcttttagcttctaatatccttgtcaataaggtgtagatcctctctctctatgaaggtttagtattttttttaatgtacgtatttacatttctaggaaaatgtaaggagatgccatgaagcattgcaagaagtgggattagtgaagaagaaaacagactacagtgcgagtccatctcgcgtgctagatgcctcatgcttcagcttcaagactgacgataaccagacagccggttcatcccaatcccaagcaaacaacaatggcaactacaaccaggcttactctccagctagcaagaggacaaggctagacatctagactcaatcaggaaaaattgcatgagatcatagacgtacacatatacacacaaagttttcttagataaaggatacataaagttaaatttgattctggctacatttctgagtacgtgcttctcaactcagaagagttcatagggaacattatacatgcatgcatgctaacaggcaaaagaaggctgaattattaagagcaatcctatttatttcctcctttgttcctttgttaactttttctttcttcttgtctactttaaatcatggcattagcaaagacatttgcgtgtatgggacaggtgatgcaatgatacaacataaaagaaggctaggcattgttttcaacataagcagaggtaatctcgtttcaggaaaaaaatgagcgccaggaactttgatatctgatcaagggagaagcaaagttagttgttgtgggaatctgtggctgagttcttggttctcgatttcttgtttgtttgtttgtctgtgatgaatatttttcagatttattcaatgaactgaccatgttatgctatagagcaagtacaacaataggttctaagcaggataaatgatgaggtacaggagagagaagatgagagagaggataagcgagctataaacttacaaccatctaagacttagatataagaataaaaaaactttgagagagacaaatgagttatgtattagtagtgaacggttaactattatgtagatggactaagagataggacgcaaatagccaatagtcagctatattattagcctcgctcttattcagcacccgggcaattttatcgtccaaatttgttagcatgcatgctacttcttatagaatgaatattagatatgcattaggcttcacatcctattcaaaataaggtgctagaggccttaaaatttaagtgttttagatgagttccatggatgaatcttagttgcgccatacatataattaatttaaaacacacaaaaaaaacactagccatatacttactatg

SEQ ID NO: 10 - DNA, 1071 bp, Zea mays
atgaagagatagattagagttaccatcatatccccaacaatggcatagccaacaagttggatccttcggaccctgtagctcctggtccatgaattgccaagagaacaccttttagtttctttgagcaacctcgatctcgccatggggttccgctgtggccgtgcctcctcttcgctgctgtgtgaagaggacgtggccggcatgtttggatgcaatgggcacgacgacgaagaggtggggcttctggtgttggggatggacacgacttttgctgcgctgccatcacagagcgacgaggtcgtagcatccctgatggagaaggagaaggagcagctgcatagcgttgcgacgggggattacctccagaggctgagcagtggaggactggagtcatcttgtaggattgccgccattgattggataaaaaaggcccaggcttatcacgactttggaccgttgtctgcttatcttgctgttaactaccttgatagggtcctctccacaaatcaagtcccagtgagttctacaaataagtacagattcgatttagatgctattcagaggatggagatttacattctagactctctgaattggaggatgcaagctgtgacgccattctcttacatcaactatttcgtggacaagttcactgatgggaagccgctaagttgcggattcatttctcggtgcaccgagatcatacttggcagtcttgaagcaacgaagctcctacagttcaggccttctgagatggcagcagcagtggttctgtcagcagctgctgagtctcaagtcattgccttcagcggcgctcttttagcttctaatatccttgtcaataaggaaaatgtaaggagatgccatgaagcattgcaagaagtgggattagtgaagaagaaaacagactacagtgcgagtccatctcgcgtgctagatgcctcatgcttcagcttcaagactgacgataaccagacagccggttcatcccaatcccaagcaaacaacaatggcaactacaaccaggcttactctccagctagcaagaggacaaggctagacatctagact

SEQ ID NO: 11 - DNA, 5918 bp, Zea mays
ttggtagtggaattagctagctaacaaataactatctaactattaactaatttaccaaaaatagctaatagttgaactattaactaaagtgtttggatgtctcaactaattttagctactaactattagctctagtgcattcaaacaccccttaagtgaatgtcatggtatgggctgacatttcgagaggtggagagtgtcatggtatgggctgccatgtgggccgagagtccgagaccgggctaaatgagctgggctgaataggactgactgcaggtagaaaggcaagcgcaacatttggcaccgttagctctccactaaacttgtcagatgcaataatttatgtttttattaatggcaaagccctcctgccagccagtgccttccttccgggtcaaccactggtacagtcacatcacgaattcccactggcagtacgataacctcactgagcggtagggcctcccgtcccagaatcctgcaggacccatcgatcatggccccacgggtcctgctcctgcgtgggttccaattccaagtcgcccaccgtgacgcccatcgagtcaaccgaacccaagccgtgtggcgactggcgaggcgagtgccccagttcctaactccggtgggcgcgctcccaccgccgcgcggctcaaaacccgccctcagcctcccgcgctccagtccacacgggagcgggtggtgtcgtctgaagcggcgcgatcaaggagtcttcgggcgctccggtgagctatctagatctcaacatcctctcccctctgtagtctgtagttgtactctcccgcccgatggttcagttaagttatatcctctccccttatttttactcggtcgataccatttcgttgtggattgggcgcccccgcaggttgaaatgctgcccatcatgctgcggccctgtactatgaggatggttctagttttgcgtctggcaatttggggcgtacatgcttttggctgcgtactgttactgatcggagaaaatgtttgtaacgtatgattcgtttttcaggacgtaacgtgctggcggttgcttatctccggatgtatatataagcggaaatgttctccttgttctatggcctgtggaagtatgtgttcgccaaggacgagttccgtgttctgattcttggtgttgacagagctggcaagacggtagctgctagctcccagccttcatatatatatttccctttctgaactagaaattgatgatacttacctgtacacgatgtttctggaaccgttgccatagactttgctggagaagttgaaatcgatatatctcaagggggaaggacttccgcctgaccgtgtcgttccaacagttgggctcaacattggccgcatcgaagacgcaaaggcaaaacttgttttctgggatctaggtggtcaggtaagaacgtttacgtacgtagtaaagtgagccttctgttgccgtggcaccaccctacgatcgttgatatttgagtcttgtcagtttggtgctatatcagggtttctaatgcctgggaaatacatgtcataaattcaaattactaggatgtggttgctttagttattaacctagcatctttttgcgttccagcagaatatatataatctagttatatggaatgctcaatagaattttcagaaagcaaagatatgctctgttggctaacattcacagtactcaatagaattgtttactagtagaacagcatcagcttctctgctatgttataagaattagtgtaaaactaacttcagtatcactgcttgctagtatgataattaagcttccatgccaagttcagtatttcttacacacttgcctgcttggcaggttagcctacgaacaatctgggagaaatactatgaagaggcccatgccataatgtacgttattgacgctgccacagcatcgtcatttgaagattccaaatctgctctgggtaaggttcttatttgtgttaattataaactactccctccattccaaattataagacattttggccttttttctagataaataaattttgctatggacttaaatattatttatatatatatatatatatatataaaatgtcctggtacatagttaaaacattatatcttaaaaagctaaaacattgtcttataacttggaacaagggagtactggtttgtttctattgctagatcttccgagaagatgcattgcctctctggtaaatgggatgagaactcattctagctagagaacctaacctaaatttcttacttcagagaaggttattcgccatgaacatctgagaggagcaccactcttgatagttgcaaacaaacaggtgaagggtttacttccactttctatattttgtaccacagtacataattatgattgaaagattcagtgcttacaataaagttgccatcgtagtaaaataaagattttgtttttgtcatgtgcccatgctgtgaggcatacaaatctaaattcctacgttgcaaagcgcctatgcgccattgcgaggttgaataccagatgtagtttggccaattgtgatgtacagatgtgccacattgacaattgacacgcagtttaaaggagagtcagactactagttttttcattgcccaacatatacctttggccacttattgaaaatgtgagagatcatttgagtttgaacagtaagttttgtgagatatcattttatttagtaatcatgcacacatgtctagaattgtgaaatgcacaataaagacgcaaactcccacgagcatgcaggtacacccgattgaggattctcagcgaatgttccagtttcgagaatcaaacaacatataacaatgatgaattttttaaatcaattaaaacttcctgaaaagatcacatggaaaccaatgactacatgcactgtctgtttctgttaagctgggtacacattattctatcaaattgtttattatttacctcttgttctcatgtttggagggtgcttctggatttcttttggcaggatttacctggagccattgatgaggaagaattggctaaatttctgcataaagaactggatgagaggccatatacatttcaggctgtatctgcatatgatgggtgagcgcagaaactcaactggttcctgaggaaatttgactcgccatgaaaaaaaatgacaattttactcaaagatacaaaaaattcacacattcgtctgttatattgtttcctgggtgcatgaaactcaactggttcgtgaggaaatttgactcgccatgaaaaaaatgacaattttactcaaagatacaaaaaattcacacattcgtctgttatattgtttcctgggtgcatgatattctaaagatctgttatattgtttaaatgtgacaccggctcttgcagcagggggatcaaatctggcatagactggctggtggaacaaatggaaaaaagcaaacgtaccgagacactgcaggctcgtgctggcgtagctggacaaatttagaatggggtgaatttgttaaagaacaaagcattggataggacggcttccttcgtatcgcgtaagcagccatttgctgcattccgggattatcgttccaggtcgcccagagtgctgcaagaaatgtttggctggttgctcctgtggtggtggtgattggtgaggcgattcgtttggtattattgaggttgcattcatatgtacctaaaggtcgcaagcatacatgtctatatgatgcttttcaattttcgtagcaaactagtagcttcaatacagaggatcaaagagagccgtgttctttaacttgtttgtgataaaaaaaaaggaagaaaggaaagcgaagaaggaattattggtgcatctgaaagtctttattgcatatgtctaaaccattttaaccgatgctggatgagcttttcttcgcaccgatgttacatctagtctatcatatgtatcctcgtttcatactcgcaccgatgttacatctagtctatcatatgtatcctcgtttcatactcgatccttttttatggccaaactccaacacaacatatacatttctgtagcgcatacgtattgaacatgtcttttttagactaacattctgcaccgaacaatatagcagatcgaattgtcatcctataaagattatttttaacttttgtggtatcctattgtcatatttattgaggttgcattcatatgtacctaaaggtcgcaagcatacatgtctatatgatgcttttcaattttcgtagcaaactagtagcttcaatacagaggatcaaagagagccgtgttctttaacttgtttgtgataaaaaaaaaggaagaaaggaaagcgaagaaggaattattggtgcatctgaaagtctttattgcatatgtctaaaccattttaaccgatgctggatgagcttttcttcgcaccgatgttacatctagtctatcatatgtatcctcgtttcatactcgcaccgatgttacatctagtctatcatatgtatcctcgtttcatactcgatccttttttatggccaaactccaacacaacatatacatttctgtagcgcatacgtattgaacatgtcttttttagactaacattctgcaccgaacaatatagcagatcgaattgtcatcctataaagattctttttaacttttgtggtatcctattgtcatatagaacatcaaatgtttggcgccacctcatcctttgactaatacctttatcactatctctacgtagcctttcgtagcatagatcctaaatatctatgcatagatcctaaatatctatgcatagatcctaaatatctaaagatgtcctttcagaacactacttgatttttcaaactaacatgtctttcctcatatgtagtagcatagattctaaatatctaaagatgtccttccggacactacttgatttttcaaactaacatgtctttcctcatatgtagtagtgttgaaatcacatcttttatattcaatttgagttctactgatcgagtccaaaatcgtccaaaacctttaaactctagaatctcccacgacaactctagttttccatttactcgtgcttagctttcatcaactaacactacatccataaaaacatatgttaagagatccctttgtgatcttatccatagactcaaagctaatttttttatgtagtcatattctaatcggaaagtcacatgtgtctccatcatttattcaaacatattcataacattgttgttggaactttgcttcctcaaaaaatagggataaaaaaaacagtaaaaggaattggcccttcaggctagggctgctgatatccccactaagctgggccaatcggccaagaaactttgcttcattcagggcatggtatggacaacccactgcgggttgccaaacaaaggagttagtaagaaaccacaaaatgcttagtctgagctttgaagagttctacttggtgagtaaaacagttaatcttaactactgcttggctaagataagatgttagtcaaaagaattctgtagatgtgcaatctcaaaccaatctgcctttgcatcatttagaaaactgctttaaaattcgaaatattttgcttaccatagctcatagcacagaagaatattatagaacaaaccaaggcaagtgactttctgaaacacagttttcaagaacaggttcagattaaactagataacaggatgccagcgttggtaataagtgtactccccaagagaagtcgctgttttgttctatctcaatgaaaaataacgacacgaaaatgaactatggccgtctgcattaatatggatactcagcaaaaatggacatgagtaactcaaaatcgtcaattgcttgctatgttaggcacccaagtcaatgatttctattccatgctatcacaaagatta

SEQ ID NO: 12 - DNA, 1288 bp, Zea mays
ttccaagtcgcccaccgtgacgcccatcgagtcaaccgaacccaagccgtgtggcgactggcgaggcgagtgccccagttcctaactccggtgggcgcgctcccaccgccgcgcggctcaaaacccgccctcagcctcccgcgctccagtccacacgggagcgggtggtgtcgtctgaagcggcgcgatcaaggagtcttcgggcgctccggacgtaacgtgctggcggttgcttatctccggatgtatatataagcggaaatgttctccttgttctatggcctgtggaagtatgtgttcgccaaggacgagttccgtgttctgattcttggtgttgacagagctggcaagacgactttgctggagaagttgaaatcgatatatctcaagggggaaggacttccgcctgaccgtgtcgttccaacagttgggctcaacattggccgcatcgaagacgcaaaggcaaaacttgttttctgggatctaggtggtcaggttagcctacgaacaatctgggagaaatactatgaagaggcccatgccataatgtacgttattgacgctgccacagcatcgtcatttgaagattccaaatctgctctggagaaggttattcgccatgaacatctgagaggagcaccactcttgatagttgcaaacaaacaggatttacctggagccattgatgaggaagaattggctaaatttctgcataaagaactggatgagaggccatatacatttcaggctgtatctgcatatgatggcagggggatcaaatctggcatagactggctggtggaacaaatggaaaaaagcaaacgtaccgagacactgcaggctcgtgctggcgtagctggacaaatttagaatggggtgaatttgttaaagaacaaagcattggataggacggcttccttcgtatcgcgtaagcagccatttgctgcattccgggattatcgttccaggtcgcccagagtgctgcaagaaatgtttggctggttgctcctgtggtggtggtgattggtgaggcgattcgtttggtattattgaggttgcattcatatgtacctaaaggtcgcaagcatacatgtctatatgatgcttttcaattttcgtagcaaactagtagcttcaatacagaggatcaaagagagccgtgttctttaacttgtttgtgataaaaaaaaaggaagaaaggaaagcgaagaaggaattattggtgcatctgaaagtctttattgcatatgtctaaaccattttaaccgatgctggatgagcttttctt

SEQ ID NO: 13 - DNA, 979 bp, Zea mays
aatcgagtcaaccgaacccaagccgtgtggcgactggcgaggcgagtgccccagttcctaactccggtgggcgcgctcccaccgccgcgcggctcaaaacccgccctcagcctcccgcgctccagtccacacgggagcgggtggtgtcgtctgaagcggcgcgatcaaggagtcttcgggcgctccggacgtaacgtgctggcggttgcttatcaccggatatatatatataagcggaaatgttctccttgttctatggcctgtggaagtatgtgttcgccaaggacgagttccgtgttctgattcttggtgttgacagagctggcaagacgactttgctggagaagttgaaatcgatatatctcaagggggaaggacttccgcctgaccgtgtcgttccaacagttgggctcaacattggccgcatcgaagacgcaaaggcaaaacttgttttctgggatctaggtggtcaggttagcctacgaacaatctgggagaaatactatgaagaggcccatgccataatgtacgttattgacgctgccacagcatcgtcatttgaagattccaaatctgctctggagaaggttattcgccatgaacatctgagaggagcaccactcttgatagttgcaaacaaacaggatttacctggagccattgatgaggaagaattggctaaatttctgcataaagaactggatgagaggccatatacatttcaggctgtatctgcatatgatgggtgagcgcagaaactcaactggttcctgaggaaatttgactcgccatgaaaaaaaatgacaattttactcaaagatacaaaaaattcacacattcgtctgttatattgtttcctgggtgcatgaaactcaactggttcgtgaggaaatttgactcgccatgaaaaaaatgacaattttactcaaagatacaaaaaattcacacattcgtcaaaaaaaaaaaaaaaaaaaaaaaa

SEQ ID NO: 14 - DNA, 1305 bp, Zea mays
aaccgaacccaagccgtgtggcgactggcgaggcgagtgccccagttcctaactccggtgggcgcgctcccaccgtcgcgcggctcaaaacccgccctcagcctcccgcgctccagtccacacgggagcgggtggtgtcgtctgaagcggcgcgatcaaggagtcttcgggcgctccggacgtaacgtgctggcggttgcttatcaccggatatatatatataagcggaaatgttctccttgttctatggcctgtggaagtatgtgttcgccaaggacgagttccgtgttctgattcttggtgttgacagagctggcaagacgactttgctggagaagttgaaatcgatatatctcaagggggaaggacttccgcctgaccgtgtcgttccaacagttgggctcaacattggccgcatcgaagacgcaaaggcaaaacttgttttctgggatctaggtggtcaggttagcctacgaacaatctgggagaaatactatgaagaggcccatgccataatgtacgttattgacgctgccacagcatcgtcatttgaagattccaaatctgctctggagaaggttattcgccatgaacatctgagaggagcaccactcttgatagttgcaaacaaacaggatttacctggagccattgatgaggaagaattggctaaatttctgcataaagaactggatgagaggccatatacatttcaggctgtatctgcatatgatgggagggggatcaaatctggcatagactggctggtggaacaaatggaaaaaagcaaacgtaccgagacactgcaggctcgtgctggcgtagctggacaaatttagaatggtaagcttgcagctgcgaccggatgaatttgttaaaagaacaaagcattggataggacggcttccttcgtatcgcgtaagcagccatttgctggattacagggattatcgttccaggccgcccagagtgctgcaagaaatgtttggctggttgctcctgtggtggtggtgattggtgaggcgattcgtttggtattagaggttgcattcatatgtacctaaaggtcacgagcatacatgtctatatgatgcttttcaattttcgtagcaaactagtagcttcaacacagaggatcaaagagagccgtgttctttaacttgtttgtgataaaaaaaaggaagaaaggaaagcgaagaaggaatcactggtgcatctgaaagtctttattggatatgtctaaaccatttcaactgatgctggataagtttttcttaaaaaaaaaaaataaaaaaaaaaaaaaaa

SEQ ID NO: 15 - DNA, 3993 bp, Zea mays
  misc_feature (2094)..(2094): n is a, c, g, or t
tgaaaatatatattgaataacttttaacggcttttagtggtttccatcaaacggtttttagctttttaacatctcacagcccacagtaactttttccacagctcacaacctatagcagcttttttcacagccacatcccaactaaaaagaccctaagtgaatgtcatggtatgggctgacatttcgagaggtggacaaatggagaatggcatgatatgggctgccatgtgggccgagggtctgagaccgggctaaatgagctgggctgaagaggactgactgtaggtagaaaggcaagcgcaacatttggcaccgttagctctccactaaacttgtcagatgcaataatttatgttttttaaatggcaaagccctcctgccagccagtgccttccttccgggtcaaccactggtaccgtcacatcacgaattcccactggcagtacgataacctcactgagcggtagggcctcccgtcccagaatcctgcaggacccatcgatcatggccccacgggtcctgctcctgcgtgggttccaattccaagtcgcccaccgtgacgcccatcgagtcaaccgaacccaagccgtgtggcgactggcgaggcgagtgccccagttcctaactccggtgggcgcgctcccaccgccgcgcggctcaaaacccgccctcagcctcccgcgctccagtccacacgggagcgggtggtgtcgtctgaagcggcgcgatcaaggagtcttcgggcgctccggtgagctatctagatctcaacatcctctcccctctgtagtctgtagttgtactctcccgcccgatggttcagttaagttatatcctctccccttatttttactcggtcgataccatttcgttgtggattgggcgcccccgcaggttgaaatgctgcccatcatgctgcggccctgtactatgaggatggttctagttttgcgtctggcaatttggggcgtacatgcttttggctgcgtactgttactgatcggagaaaatgtttgtaacgtatgattcgtttttcaggacgtaacgtgctggcggttgcttatctccggatgtatatataagcggaaatgttctccttgttctatggcctgtggaagtatgtgttcgccaaggacgagttccgtgttctgattcttggtgttgacagagctggcaagacggtagctgctagctcccagccttcatatatatatttccctttctgaactagaaattgatgatacttacctgtacacgatgtttctggaaccgttgccatagactttgctggagaagttgaaatcgatatatctcaagggggaaggacttccgcctgaccgtgtcgttccaacagttgggctcaacattggccgcatcgaagacgcaaaggcaaaacttgttttctgggatctaggtggtcaggtaagaacgtttacgtacgtagtaaagtgagccttctgttgccgtggcaccaccctacgatcgttgatatttgagtcttgtcagtttggtgctatatcagggtttctaatgcctgggaaatacatgtcataaattcaaattactaggatgtggttgctttagttattaacctagcatctttttgcgttccagcagaatatatataatctagttatatggaatgctcaatagaattttcagaaagcaaagatatgctctgttggctaacattcacagtactcaatagaattgtttactagtagaacagcatcagcttctctgctatgttataagaattagtgtaaaactaacttcagtatcactgcttgctagtatgataattaagcttccatgccaagttcagtatttcttacacacttgcctgcttggcaggttagcctacgaacaatctgggagaaatactatgaagaggcccatgccataatgtacgttattgacgctgccacagcatcgtcatttgaagattccaaatctgctctgggtaaggttcttatttgtgttaattataaactactccctccattccaaattataagacattttggccttttttctagataaataaattttgctatggacttaaatattatttatatatatatatatatatantatatatatatatatatataaaatgtcctggtacatagttaaaacattatatcttaaaaagctaaaacattgtcttataacttggaacaagggagtactggtttgtttctattgctagatcttccgagaagatgcattgcctctctggtaaatgggatgagaactcattctagctagagaacctaacctaaatttcttacttcagagaaggttattcgccatgaacatctgagaggagcaccactcttgatagttgcaaacaaacaggtgaagggtttacttccactttctatattttgtaccacagtacataattatgattgaaagattcagtgcttacaataaagttgccatcgtagtaaaataaagattttgtttttgtcatgtgcccatgctgtgaggcatacaaatctaaattcctacgttgcaaagcgcctatgcgccattgcgaggttgaataccagatgtagtttggccaattgtgatgtacagatgtgccacattgacaattgacacgcagtttaaaggagagtcagactactagttttttcattgcccaacatatacctttggccacttattgaaaatgtgagagatcatttgagtttgaacagtaagttttgtgagatatcattttatttagtaatcatgcacacatgtctagaattgtgaaatgcacaataaagacgcaaactcccacgagcatgcaggtacacccgattgaggattctcagcgaatgttccagtttcgagaatcaaacaacatataacaatgatgaattttttaaatcaattaaaacttcctgaaaagatcacatggaaaccaatgactacatgcactgtctgtttctgttaagctgggtacacattattctatcaaattgtttattatttacctcttgttctcatgtttggagggtgcttctggatttcttttggcaggatttacctggagccattgatgaggaagaattggctaaatttctgcataaagaactggatgagaggccatatacatttcaggctgtatctgcatatgatgggtgagcgcagaaactcaactggttcctgaggaaatttgactcgccatgaaaaaaaatgacaattttactcaaagatacaaaaaattcacacattcgtctgttatattgtttcctgggtgcatgaaactcaactggttcgtgaggaaatttgactcgccatgaaaaaaatgacaattttactcaaagatacaaaaaattcacacattcgtctgttatattgtttcctgggtgcatgatattctaaagatctgttatattgtttaaatgtgacaccggctcttgcagcagggggatcaaatctggcatagactggctggtggaacaaatggaaaaaagcaaacgtaccgagacactgcaggctcgtgctggcgtagctggacaaatttagaatggggtgaatttgttaaagaacaaagcattggataggacggcttccttcgtatcgcgtaagcagccatttgctgcattccgggattatcgttccaggtcgcccagagtgctgcaagaaatgtttggctggttgctcctgtggtggtggtgattggtgaggcgattcgtttggtattattgaggttgcattcatatgtacctaaaggtcgcaagcatacatgtctatatgatgcttttcaattttcgtagcaaactagtagcttcaatacagaggatcaaagagagccgtgttctttaacttgtttgtgataaaaaaaaaggaagaaaggaaagcgaagaaggaattattggtgcatctgaaagtctttattgcatatgtctaaaccattttaaccgatgctggatgagcttttcttcgcaccgatgttacatctagtctatcatatgtatcctcgtttcatactcg

SEQ ID NO: 16 - DNA, 6492 bp, Zea mays
cgaagaacaaggaaagcacttgtccatcaattgcacttgagtagcaaaggtttcaggttgtcggtgctgacatctcttctactctgttaagaccaggctaagggggtgtttgaatgcactagaactaatagttagttggctaaaaattggtagtggaattagctagctaacaaataactatctaactattaactaatttaccaaaaatagctaatagttgaactattaactaaagtgtttggatgtctcaactaattttagctactaactattagctctagtgcattcaaacaccccttaagtgaatgtcatggtatgggctgacatttcgagaggtggagagtgtcatggtatgggctgccatgtgggccgagagtccgagaccgggctaaatgagctgggctgaataggactgactgcaggtagaaaggcaagcgcaacatttggcaccgttagctctccactaaacttgtcagatgcaataatttatgtttttattaatggcaaagccctcctgccagccagtgccttccttccgggtcaaccactggtacagtcacatcacgaattcccactggcagtacgataacctcactgagcggtagggcctcccgtcccagaatcctgcaggacccaccgatcatagccccacgggtcctgctcctgcgtgggttccagttccaagtcgcccaccgtgacgcccatcgagtcaaccgaacccaagccgtgtggcgactggcgaggcgagtgccccagttcctaactccggtgggcgcgctcccaccgccgcgcggctcaaaacccgccctcagcctcccgcgctccagtccacacgggagcgggtggtgtcgtctgaagcggcgcgatcaaggagccttcgagcgctccggtgagctatctagatctcaacatcctctcccctctgtagtctgtagttgtactctcccgcccgatggttcagttaagttatatcctctccccttatttttactcggtcgataccatttcgttgtggattgaaatgctgcggccctgtactatgaggatggttcctagttttgcgtctggcaatttggggcgtacatgcttttggctgcgtactgttactgatcggagaaaatgtttgtaacgtatgattcgtttttcaggacgtaacgtgctggcggttgcttatcgccggatatatatatataagcggaaatgttctccttgttctatggcctgtggaagtatgtgttcgccaaggacgagttccgtgttctgattcttggtgttgacagagctggcaagacggtagctgctagctcccagccttcatatatatatatttccctttctgaactagaaattgatgaaacttacctgtacacaatgtttctggaaccgttgccatagactttgctggagaagttgaaatcgatatatctcaagggggaaggacttccgcctgaccgtgtcgttccaacagttgggctcaacattggccgcatcgaagacgcaaaggcaaaacttgttttctgggatctaggtggtcaggtaagaacgtttacgtacgtagtaaagtgagccttctgttgccgtggcaccaccctacgatcgttgatatttgagtcttgtcagtttggtgctatatcagggtttctaatgcctgggaaatacatgtcataaaatcaaattactaggatgtggttgctttagttattaacctagcatctttttgcgttccagcagaatatatataatctagttatatggaatgctcaatagaattttcagaaagcaaagatatgctctgttggctaacattcacagtactcaatagaattgggtggctagtagaacagcatcagcttctctgctatgttataagaattagtgtaaaactaacttcagtatcactgcttgctagtatgataattaagcttccatgccaagttcagtatttcttacacacttgcctgcttggcaggttagcctacgaacaatctgggagaaatactatgaagaggcccatgccataatgtacgttattgacgctgccacagcatcgtcatttgaagattccaaatctgctttgggtaaggttcttatttgtgtcaattataaactacgccatccattccaaattataagacattttggcctttttctagataaataaattttgctatggacttaaatattaaaaatatatataatgtcctggtacatagttaaaacaatatatctagaaaagctaaaacatcgtcttataacttggaacagagggagtactggtttgtttctattgctagatctttccagaagatgcaatgcctctctggtaaatgggatgagaactcattctagagaacctaacctaaatttcttacttcagagaaggttattcgccatgaacatctgagaggagcaccactcttgatagttgcaaacaaacaggtgaagggtttacttccactttctatattttgtaccacagtacataattatgattgaaagatttagtgcttacaataaagttgccatcgtagttaaaataaagattttgtttttgtcatgtgcacatgctgtgaggcatacaaatataaattcctacgttgcaaagcgcctatgcgccattgcgaggttgaataccagatgtagtttttaaatcaattaaaacttcctgaaaagatcacatggaaaccaatgactacatgcactgtctgtttctgttaagctgggtacacattattctatcaaattgtttattatttacctctagcttgttctcatgtttggagggtgcttctggatttcttttggcaggatttacctggagccattgatgaggaagaattggctaaatttctgcataaagaactggatgagaggacatatacatttcaggctgtatctgcatatgatgggtgagcgcagaaactcaactggttcctgaggaaatttgactcgccatgaaaaaaatgacaattttactcaaagatacaaaaaaattcacacattcgtctgttatattgtttcctgggtgcatgatattctaaagatctgttatattgtttaaatgtgacaccggctcttgcaggagggggatcaaatctggcatagactggctggtggaacaaatggaaaaaagcaaacgtaccgagacactgcaggctcgtgctggcgtagctggacaaatttagaatggggtgaatttgttaaagaacaaagcattggataggaccgcttccttcgtatcgcgtaagcagccatttgctgcattccgggattatcgttccaggtcgcccagagtgctgcaagaaatgtttggctggttgctcctgtggtggtggtgattggtgaggcgattcgtttggtattattgaggttgcattcttatgtacctaaaggtcgcaagcatacatgtttatatgatgcttttcaattttcgtagcaaactagtagcttcaatacagaggatcaaagagagccgtgttctttaacttgtttgtgataaaaaaaaggaagaaaggaaagcgaagaaggaattattggtgcatctgaaagtctttattgatatgtctaaaccatttcaaccgatgttggatgaggttttcttcgcaccggtgttacatctagtctatcatatgtatcgtcgtttcatactcgatccttttttatggccaaactccaacacaacatatgcatttctgtagcgcatatgtattgaacatgtcttttttagactaacattttgcaccgaacaacatagcagatcgaattgtcatcctataaaacttctttttaacttttgtggtatcctattgtcatatagaatatcaaatgtttggcgctacctcatccattgactaatacctttatcaatatctctacgtagcatagatcctaaatatctaaagatgtccttcatggacactacttgatttttcaaactaacatgtctttcctaatatgtagtagcatagatcctaaatatctaaagatgtccttcctggacactacttgatttttcaaactaacatgtctttcctcatatgtagtagtgttgaaatcacatcttttatattcaatttgagttctactgatcgagtccaaaatcgtccaaaacctttaaactctagaatctcccaccacaactctagttttctatttactcgtgcttagctttcatcaactaacactacatccataaaaaacatatgttaagagatatccctttgtgatcttatccatagactcagctaattttttatgtagtcatattctaatcgaaaagtcacatgtgtctccatcatttattcaaacatattcataacattgttgttggaactttgcttcctcaaaaaacagggataaaaaacagtaaaaggaattggcccttcaggctagagctgctgatatccccactaagctgggccaatcggccaagaaactttgcttcattcagggcatgatatggacaacccactgcggattgccaaacaaagaagttagtaagaaaccacaaaatgcttagtctgagctttgaagagttctacttggtgagtaaaacagttaatcttaactactgcttggctaagataagatgttagctaaaagaattctgtagatgtgcaatctcaaaccaatctgcctttgcatcatttagaaaactgctttaaaattcgaaatattttgcttacaatagctcatagcacagaagaatattatagaacaaaccaaggcaagtgactttctgaaacacagttttcaagaacaggttcagattaaactagataacaggatgccagcgttggtaataagtctactccccaagagaagtcactgttttgttctttctcaatgaaaaataacgacacaaaaatgaactatggccgtctgcattaatatggatacgcagcaaaaatggacatgagtaactcaaaatcgtcaagtgcttgctatgttaagcacccaagtcaatgatttatattccatgatatcgcaaagattatctataacaagttctgagtgtgtttcaaacattaaatgatccatgaaaggtaagcacttgtatttagcggacagtactagtctgctgtgggattaacccattttttatggttctcgatggccttttgcttcaagataatatctgatccaattaatagacaaaatcacaagtaatctttgttacatgtcatcatcgaatcctatcttctgtaggagcaaacttaaacggtgacatatcaagcaacactatgagaattcatgtgtatctgataaaggatcattcacttcacatgtagacatatatgactacaaaagtggtatgaatattgttaacagaatcaatggaaaatggaatatatctcattaggtaacatatggaattgtaagcaggctataaaaaatcagaggtattaagtatcaattcagacagcagaatgatgcaatgatcacaaccaagtcaacaagttatcataactaagattagtccttttgtagccaaagaagtttaccgaactcagaaagcagaacataattcacttacttgatctcaacaacattttgtgtcaccatgccaggaagaaaccagaagtggcatggtaagcattgccagtccaaccagacctctgtgaagcattatcccatcactggaaacctccacaaagcgtgtttgctaaggcaaatggcatgtatctccatctaatgaacatacaaattttgccctgcctgatgttaagtaactacaggtaccaggtagactacaagtctacaactacaacattacataacagggatggaacaattacactcaaatgaacacttgaacagcaagagccagtctctgagacatctgcttcggcctggctaatcatagccccagtaaaccataacaacagttaaatcatccgtccaagattgtccaccctcaagaagtgcatgttgtgcaaattccccaatatatcctcagatgcatcaacatcgatatgaaagttgctgatatcttcaactccgccagcaccgctaacattaaccctaccagtgccatctgtagcatgtgctgcctcatttatgttaattctcctcacctcctcggcccttccatctccagcgttctcatccccagcccagccttcctgcccgagcatcgaagaatcaatgccactctccacaccaagagaacgtctcctgagccctaccccgaccttcttgcgggccgtcgtcttcttgatcctacctctagaagagccaccacgagcactgtcattctgtggctgcctaccaccatggtttccgtgactcctaccaccaccaccttggccactgggagccgtgttccaaggaaacatcttgtagaatggcttccagttggcacccaggtcggccgcgttgggaaatccgagggggaagaacccccaggcgcagtggtacatttcagtgcccggcacaacggtgggtggggtcgggagctcagaagccacgaatccgcggcggcagcccgcg

SEQ ID NO: 17 - DNA, 10054 bp, Zea mays
tttggatgtctcaactaattttagctactaactattagctctagtgcattcaaacaccccttaagtgaatgtcatggtatgggctgacatttcgagaggtggagagtgtcatggtatgggctgccatgtgggccgagagtccgagaccgggctaaatgagctgggctgaataggactgactgcaggtagaaaggcaagcgcaacatttggcaccgttagctctccactaaacttgtcagatgcaataatttatgtttttattaatggcaaagccctcctgccagccagtgccttccttccgggtcaaccactggtacagtcacatcacgaattcccactggcagtacgataacctcactgagcggtagggcctcccgtcccagaatcctgcaggacccaccgatcatagccccacgggtcctgctcctgcgtgggttccagttccaagtcgcccaccgtgacgcccatcgagtcaaccgaacccaagccgtgtggcgactggcgaggcgagtgccccagttcctaactccggtgggcgcgctcccaccgccgcgcggctcaaaacccgccctcagcctcccgcgctccagtccacacgggagcgggtggtgtcgtctgaagcggcgcgatcaaggagccttcgagcgctccggtgagctatctagatctcaacatcctctcccctctgtagtctgtagttgtactctcccgcccgatggttcagttaagttatatcctctccccttatttttactcggtcgataccatttcgttgtggattgaaatgctgcggccctgtactatgaggatggttcctagttttgcgtctggcaatttggggcgtacatgcttttggctgcgtactgttactgatcggagaaaatgtttgtaacgtatgattcgtttttcaggacgtaacgtgctggcggttgcttatcgccggatatatatatataagcggaaatgttctccttgttctatggcctgtggaagtatgtgttcgccaaggacgagttccgtgttctgattcttggtgttgacagagctggcaagacggtagctgctagctcccagccttcatatatatatatttccctttctgaactagaaattgatgaaacttacctgtacacaatgtttctggaaccgttgccatagactttgctggagaagttgaaatcgatatatctcaagggggaaggacttccgcctgaccgtgtcgttccaacagttgggctcaacattggccgcatcgaagacgcaaaggcaaaacttgttttctgggatctaggtggtcaggtaagaacgtttacgtacgtagtaaagtgagccttctgttgccgtggcaccaccctacgatcgttgatatttgagtcttgtcagtttggtgctatatcagggtttctaatgcctgggaaatacatgtcataaaatcaaattactaggatgtggttgctttagttattaacctagcatctttttgcgttccagcagaatatatataatctagttatatggaatgctcaatagaattttcagaaagcaaagatatgctctgttggctaacattcacagtactcaatagaattgggtggctagtagaacagcatcagcttctctgctatgttataagaattagtgtaaaactaacttcagtatcactgcttgctagtatgataattaagcttccatgccaagttcagtatttcttacacacttgcctgcttggcaggttagcctacgaacaatctgggagaaatactatgaagaggcccatgccataatgtacgttattgacgctgccacagcatcgtcatttgaagattccaaatctgctttgggtaaggttcttatttgtgtcaattataaactacgccatccattccaaattataagacattttggcctttttctagataaataaattttgctatggacttaaatattaaaaatatatataatgtcctggtacatagttaaaacaatatatctagaaaagctaaaacatcgtcttataacttggaacagagggagtactggtttgtttctattgctagatctttccagaagatgcaatgcctctctggtaaatgggatgagaactcattctagagaacctaacctaaatttcttacttcagagaaggttattcgccatgaacatctgagaggagcaccactcttgatagttgcaaacaaacaggtgaagggtttacttccactttctatattttgtaccacagtacataattatgattgaaagatttagtgcttacaataaagttgccatcgtagttaaaataaagattttgtttttgtcatgtgcacatgctgtgaggcatacaaatataaattcctacgttgcaaagcgcctatgcgccattgcgaggttgaataccagatgtagtttttaaatcaattaaaacttcctgaaaagatcacatggaaaccaatgactacatgcactgtctgtttctgttaagctgggtacacattattctatcaaattgtttattatttacctctagcttgttctcatgtttggagggtgcttctggatttcttttggcaggatttacctggagccattgatgaggaagaattggctaaatttctgcataaagaactggatgagaggacatatacatttcaggctgtatctgcatatgatgggtgagcgcagaaactcaactggttcctgaggaaatttgactcgccatgaaaaaaatgacaattttactcaaagatacaaaaaaattcacacattcgtctgttatattgtttcctgggtgcatgatattctaaagatctgttatattgtttaaatgtgacaccggctcttgcaggagggggatcaaatctggcatagactggctggtggaacaaatggaaaaaagcaaacgtaccgagacactgcaggctcgtgctggcgtagctggacaaatttagaatggggtgaatttgttaaagaacaaagcattggataggaccgcttccttcgtatcgcgtaagcagccatttgctgcattccgggattatcgttccaggtcgcccagagtgctgcaagaaatgtttggctggttgctcctgtggtggtggtgattggtgaggcgattcgtttggtattattgaggttgcattcttatgtacctaaaggtcgcaagcatacatgtttatatgatgcttttcaattttcgtagcaaactagtagcttcaatacagaggatcaaagagagccgtgttctttaacttgtttgtgataaaaaaaaggaagaaaggaaagcgaagaaggaattattggtgcatctgaaagtctttattgatatgtctaaaccatttcaaccgatgttggatgaggttttcttcgcaccggtgttacatctagtctatcatatgtatcgtcgtttcatactcgatccttttttatggccaaactccaacacaacatatgcatttctgtagcgcatatgtattgaacatgtcttttttagactaacattttgcaccgaacaacatagcagatcgaattgtcatcctataaaacttctttttaacttttgtggtatcctattgtcatatagaatatcaaatgtttggcgctacctcatccattgactaatacctttatcaatatctctacgtagcatagatcctaaatatctaaagatgtccttcatggacactacttgatttttcaaactaacatgtctttcctaatatgtagtagcatagatcctaaatatctaaagatgtccttcctggacactacttgatttttcaaactaacatgtctttcctcatatgtagtagtgttgaaatcacatcttttatattcaatttgagttctactgatcgagtccaaaatcgtccaaaacctttaaactctagaatctcccaccacaactctagttttctatttactcgtgcttagctttcatcaactaacactacatccataaaaaacatatgttaagagatatccctttgtgatcttatccatagactcagctaattttttatgtagtcatattctaatcgaaaagtcacatgtgtctccatcatttattcaaacatattcataacattgttgttggaactttgcttcctcaaaaaacagggataaaaaacagtaaaaggaattggcccttcaggctagagctgctgatatccccactaagctgggccaatcggccaagaaactttgcttcattcagggcatgatatggacaacccactgcggattgccaaacaaagaagttagtaagaaaccacaaaatgcttagtctgagctttgaagagttctacttggtgagtaaaacagttaatcttaactactgcttggctaagataagatgttagctaaaagaattctgtagatgtgcaatctcaaaccaatctgcctttgcatcatttagaaaactgctttaaaattcgaaatattttgcttacaatagctcatagcacagaagaatattatagaacaaaccaaggcaagtgactttctgaaacacagttttcaagaacaggttcagattaaactagataacaggatgccagcgttggtaataagtctactccccaagagaagtcactgttttgttctttctcaatgaaaaataacgacacaaaaatgaactatggccgtctgcattaatatggatacgcagcaaaaatggacatgagtaactcaaaatcgtcaagtgcttgctatgttaagcacccaagtcaatgatttatattccatgatatcgcaaagattatctataacaagttctgagtgtgtttcaaacattaaatgatccatgaaaggtaagcacttgtatttagcggacagtactagtctgctgtgggattaacccattttttatggttctcgatggccttttgcttcaagataatatctgatccaattaatagacaaaatcacaagtaatctttgttacatgtcatcatcgaatcctatcttctgtaggagcaaacttaaacggtgacatatcaagcaacactatgagaattcatgtgtatctgataaaggatcattcacttcacatgtagacatatatgactacaaaagtggtatgaatattgttaacagaatcaatggaaaatggaatatatctcattaggtaacatatggaattgtaagcaggctataaaaaatcagaggtattaagtatcaattcagacagcagaatgatgcaatgatcacaaccaagtcaacaagttatcataactaagattagtccttttgtagccaaagaagtttaccgaactcagaaagcagaacataattcacttacttgatctcaacaacattttgtgtcaccatgccaggaagaaaccagaagtggcatggtaagcattgccagtccaaccagacctctgtgaagcattatcccatcactggaaacctccacaaagcgtgtttgctaaggcaaatggcatgtatctccatctaatgaacatacaaattttgccctgcctgatgttaagtaactacaggtaccaggtagactacaagtctacaactacaacattacataacagggatggaacaattacactcaaatgaacacttgaacagcaagagccagtctctgagacatctgcttcggcctggctaatcatagccccagtaaaccataacaacagttaaatcatccgtccaagattgtccaccctcaagaagtgcatgttgtgcaaattccccaatatatcctcagatgcatcaacatcgatatgaaagttgctgatatcttcaactccgccagcaccgctaacattaaccctaccagtgccatctgtagcatgtgctgcctcatttatgttaattctcctcacctcctcggcccttccatctccagcgttctcatccccagcccagccttcctgcccgagcatcgaagaatcaatgccactctccacaccaagagaacgtctcctgagccctaccccgaccttcttgcgggccgtcgtcttcttgatcctacctctagaagagccaccacgagcactgtcattctgtggctgcctaccaccatggtttccgtgactcctaccaccaccaccttggccactgggagccgtgttccaaggaaacatcttgtagaatggcttccagttggcacccaggtcggccgcgttgggaaatccgagggggaagaacccccaggcgcagtggtacatttcagtgcccggcacaacggtgggtggggtcgggagctcagaagccacgaatccgcggcggcagcccgcgttggggcacttgagggcgcgcccgatcaggctgcgcgggtactggtgcacgtagcagcagaaggggcacgccgtccagaactccggggtgtccgaggcgggagcggccgcggcgggatactgggaggagtaaggggtaccagtggcgggatcggcgggcggcggggggcggcgagagggatccgagaggaaggcgtaggcgtcgttgacgaggcggagcgccatctcggctcccgggtgcgggttgctggggccgaggaggagcgcgaggcggcggaaggcgcgggacacggcggcctggtcggggctgactccgggcggcagctggaggatggcgagcgggtccggctggcccgaggggcccatgaactgggaagcgaggaggacgtcggcgacggcgaggagctcgtcaacgccagcgaggagcgggttcgcctccatcgaccgctccgcgaagcgcttgcagccgacgaggtcgcgcgccgcgaggagcttctcggcgatctccagccagcgctccgcctgcgcggggccgtcgctggcgcctccgccgcccccgctcacgctcccgccggtggagaagtccatggtttgggggaggaaaaggtggatgctgtcggaggcagctggtttggttttggggagggggaagatcctgctgcccgaggggctcttgactggcgactgtctgtcagtccgagagtattttgttgggcagcacatttattttaaggacaactgtgattatacgttttcaacttcgtgaattattgattacgaaaattaaaaatgaggggtaaaatcataattgtaagggaagagaaggatatactcaaaattaatctgaaaataatattaaactttttatggttaattgtgattatagccttctctcactttacaattgtgattttaccccttatttttatttttaatcactaattctgatttttattaacgttgataaggcggtgcaaacaacggctttgttttcaaaacagaggggtaacaaagttaaaaaagaagggataaaatcacaattaaaatattagaaaagggtataatcacaattatcccttgattttattaggctctctccaatcattctccatctcaaatcccacatttggactttctattcatatttaaatatcctcatcttcactattatttccctattttacctcctctccaagcatccctctattcagctctccctttaccctttaactaagctatttgacttttctacatcagtttttagagtttttaatatttataatatcataatacacattgtcacttaaccaaacttatagcagattaattttatagttaaaaacactaattagtgaagagtagggttctatctttctcgttttacaaggtgttttccttctctcaccctacaagagggaggagagggacctgttgaagctctctcgatgtacgaaatcaccgaatacgtcgtgaaggggaggggaaaggatccgttggagagcgtcttatagcctgttagcttcgaattaaagtcagttgtttagattattgtagctgcaattcacagagaccaaaacactacagaaatagtaaaagccgtttcgaattaaaaccaagggaacgggctattagttttcccatatgcaaacataccagaccattgtagcgccccaccgcagagcaagttttgcatacaatcaatgtataattggactaccaaaaaccataaaaaattctaaaaatatataaatataatttattgtttactttattagattataaaattttaagtttaaatttatacaatagtaaaagaaaaaatatattcaattagataaaaaaaattccctcaattccgtaaaataaggcctgcattttaaaaaaaaaagactcaatgttttaaaacttttgactagtaattcagccaaaagcatatattttagtatatacatgttatatacttgatttgtattcaaaaattactttaatttaatgctcgttatgtttttattgatagcatattttgaaataaacaaatagtcaaagtttcgctccaaagactgtaccaaaaatatataccttgttatataagatgaatgaattatatattaacatagcataaatcaatctaggatcttaaatatgatatattgataaagtaaataatatatatgtataattttttaaatatttttgtgacttttgatagttggattgtatagaatgtttggttgcacaatagtattttcctcaagtgaaagatcttcatcaatgttgtaatacagtgacatgtcatcatcaagcctggttagatctatcctcaaaatctactccataaatttaagggccaattccctgtatgccactagaaaatatactcattccttgtatgccactgaccccacatgtcatagacaccaaaaaatatacctatatgccactcagtggcacacaaggaatgagtataaaatttgatggcataccaggaattttctctaaatttaatttagagtttctagagtacttctcttttaacttcaccttttttagctacacttgtttggttgaaatatagagccgcacagtcccaaacaaactctaaggatgagttgatgtatccccaagtatatcttacaaaaaatgatataatgactctatttatcttatagggtatttgtgattataccctctctggtcttgaaattgtgattttacccatcgtttttcaactttgtgatattttatcccttcattttgaaaacgaagagttgccatacccttgtgccgttagatgcagttaacaatgttaaatttgatgcaaaagataaaaatacccaagcaatttattttgattttaccctcgttatattatgtaatagtgatttcacccctattagggttgtgcccataaagaatagaaaaaggtagtttgaacctttcacccatttattttctcatttttttatttttaatcactaattctgattttcactaacgatgttgagagtgaagggcaaatggtagcttcgtatttaaaacggaggtgtaaaattagaaagttgaaaatgcagagtaaaatcacaattgcaaggccaacgaagggtataatcacaattatctcttatcttactagtagtaattattagattgtgaggaataaagtaatggcagattatttcattctattttataaaccaaacaaaacttggaaaagtaaaaatatgatggagtgtatgtgggggtggttagggaggaaaggcccaaaacaaagggttttcgaatcttacctaaataaaaatcatggcaagctaaattgctaaaacaagaatctaacgtgtttgtttggcacttgcataaagatggtatcttttctattaattatatgtataaattcttagttactaatggaattaatgttttatgaataatttggtgtctaaagatacctttaaagataaaaatcttcatgtagttctttcaaaaaaagagggtcattctcacaatctcacaaaaggtaattttatcaaaaagaaattgaaatagtgacacaacttgctcttttgagccacaaaccatctgatacatattttctttgagtgcacttatgctaggttactatagagagaagtttatatttttttttctcgaacacgcaggaaaactgcgcatcattatattgaaagagagaaaggtccgaaatggaccaaagtacaaagccaagcaggcaaaaaataaaaaggaaaaatagtacagcctcatgcactaggaatagccctgatcctagcaaaagcagccagaag

SEQ ID NO: 18 - DNA, 5714 bp, Zea mays
atcacgcctcgcccgagcctagcctcgggcaagggcagccgaccccgaaggggtttccgtctcgcccgaggccccccttcaacggcggacacatctccggcttgcccgaggccttgccttcgctgagaagcaaccctgactgaatcgccgcaccgaccggccaagtcgcaggagcatttaacgcaaaggaaaccaggccctgccaaaggcaccataggaaactccgctccgcccaacccagggctcggactcgggcaaagccccggaagacggcgaactccgctccgcccgacccagggctcggactcgggctaagccccggaagacggcgaactccgctccgcccgacccagggctcggactcgggctaagccccggaagacggcgaactccgctccgcccgaccaagggctcggactcgggctaagccccggaagacggcgaactccgctccgcccgaccaagggctcggactcgggctaagccccggaagacggcgaactccgctccgcccgaccaagggctcggactcgggctaagccccggaagacgacgaactccgcctcgcccgacctaggggctcggactcggcctctgctgacgaactctgcctcgcccgacccaggggctcggactcggcctctgctgacgaactccgcctcgcccgacccaggggctcggactcggcctctgctgacgaactccgcctcgcccgacccgggggctcggactcggcctctgctgacgacctccgcctcgcccgacccaggggctcggactcggcttctgctgacgacctccgcctcgcccgacccaggggctcggactcggcctcggccatggaagacagactcgaccccggcttcggaggagcctccacgtcgcccaacctagggcccaggccagccacgtcgacaggaagcgccatcatcaccctaccccgagccgactcgggtcgcagagaacaagacctgtgtcccatctggctggctccgccagataggcaatgatggcgccccgctagccccgtgacgacggcggctctcagctctcttacggaagcagggcgacgtcagcaaggacacaaccgttccaacagctgtccctccgccaggctccgttgctcctccgacagccacgacatcacgccagcagggtgccaagatctctccggctgccatattggcatgtacttagggcactagctctccccccgctagacacgtagcactccgctacaccccattgtacgcctggatcctctccttacgcctataaaaggaaggaccagggccttcttagagaaggttggccgcgcggggacgaggacggggacaggcactctcttgcggccgctcgcttccctcacccgtgtggacgcttgtaaccccctattgcaagcgcacccgacctgggcgcgggacgaacacgaaggccgcgggattcccacctctctctcgccggactccggcctcctcgctcctttcccccttcgcgctcgcccacgcgctcgacccatctgggctggggcacgcagcacactcactcgtcggcttagggaccccccggtctcgaaacgccgacactactcttgaggagattattagattatcataatctaggctttagattatataatctgaacacataatctagttgtttgtttatctaatggattatttacgctagattatataatctggagagattataatctgaaacaaacatggccttagtgattaaaaataaaaataaggggtaaaatcacaattgtaaagtgagagaaggctataatcacaattaaccataaaaagtttaatattattttcaggttaattttgagtatatccttctcttcccttacagttatgattttaccccttatttttaatttttgtaatcaataattcacaaagttgaaaacgtataatcacagttgtccttaaaattaaatgtgctgcccaacaaaatactctcggactgacagacagtcgccagtcaagagcccctcgggcagcaggatcttccccctccccaaaaccaaaccagctgcctccgacagcatccaccttttcctcccccaaaccatggacttctccaccggcgggagcgtgagcgggggcggcggaggcgccagcgacggccccgcgcaggcggagcgctggctggagatcgccgagaagctcctcgcggcgcgcgacctcgtcggctgcaagcgcttcgcggagcggtcggtggaggcgaacccgctcctcgccggcgttgacgaactcctcgccgtcgccgacgtcctcctcgcttcccagttcatgggcacctcgggccagccggacccgctcgccatcctccagctgccgcccggagtcagccccgaccaggccgccgtgtcccgcgccttccgccgcctcgcgctcctcctcggtcccagcaacccgcacccgggagccgagatggcgctccgcctcgtcaacgacgcctacgccttcctctcggatccctctcgccgccccccgccgcccgccgatcccgccactggtaccccttactcctcccagtatcccgccgcggccgctcccgcctccgacaccccggagttctggacggcgtgccccttctgctgctacgtgcaccagtacccgcgcagcctgatcgggcgcgccctcaagtgccccaacgcgggctgccgccgcggattcgtggcttctgagctcccgaccccacccacggttgtgccgggcactgaaatgtaccactgcgcctgggggttcttccccctcggatttcccaacgcggccgacctgggtgccaactggaagccattctacaagatgttcccttggaacacggctcccagtggccaaggtggtggtggtaggagtcacggaaaccatggtggtaggcagccacagaatgacagtgctcgtggtggctcttctagaggtaggatcaagaagacgacggcccgcaagaaggtcggggtagggctcaggagacgttctcttggtgtggagagtggcattgattcttcgatgctcgggcaggaaggctgggctggggatgagaacgctggagatggaagggccgaggaggtgaggagaattaacataaatgaggcagcacatgctacagatggcactggtagggttaatgttagcggtgctggcggagttgaagatatcggcaactttcatatcgatgttgatgcatccgaggatatattggggaatttgcacaacatgcacttcttgagggtggacaatcttggacggatgatttaactgttgttatggtttactggggctatgattagccaggccgactcttgctgttcaagtgttcatttgagtgtaattgttccatccctgttatgtaatgttgtagttgtagacttgtagtctacctggtacctgtagttacttaacatcaggcagggaaaaatttgtatgttcattagatggagatacatgccatttgccttagcaaacacactttgtggaggtttccagtgatgggataatgcttcgcagaggtgtggttggactggcaatgcttaccatgccacttctggtttcttcctggcatggtgacacaaaatgttgttgagatcaagtaagtgaattatgttctgctttctgagttcggtaaacttctttggctacaaaaggactaagcttagttatgctaacttgttgatttggttgtgatcattgcatcattctgctgtgtgaattgatacttaatacctctgattttttatagcctgcttacaattacatatgttacctaatgagatatattccattttccattgattctgttaacaatattcataccactttggtcgtgataaattcatttgactattgtatagaagtcatatatgtctacatgtgaagtgaatgatccattatcagatacacatgaattctcatagtgttgcttgatatgtcaccgtttaagtttgctcctacagaagataggattcgatgattacatgtaacaaagattagttgtgattttgtctattaattggatgagatattatcttgaagcaaaaggtcatcgagaaccataaaaaatgggttaatcccacagcagactagtactgtccgctaaatacaagtgcttacctttcctggaccatttaatctttgaaacacacgcagaacttgttatagataatctttgtgatagcatggaatagaaatcattgacttgggtgcctaacatagcaagcaattgacgattttgagttactcatgtccatttttgctgagtatccatattaatgcagacggccatagttcattttcgtgtcgttatttttcattgagatagaacaaaacagcgacttctcttggggagtacacttattaccaacgctggcatcctgttatctagtttaatctgaacctgttcttgaaaactgtgtttcagaaagtcacttgccttggtttgttctataatattcttctgtgctatgagctatggtaagcaaaatatttcgaattttaaagcagttttctaaatgatgcaaaggcagattggtttgagattgcacatctacagaattcttttgactaacatcttatcttagccaagcagtagttaagattaactgttttactcaccaagtagaactcttcaaagctcagactaagcattttgtggtttcttactaactcctttgtttggcaacccgcagtgggttgtccataccatgccctgaatgaagcaaagtttcttggccgattggcccagcttagtggggatatcagcagccctagcctgaagggccaattccttttactgttttttttatccctattttttgaggaagcaaagttccaacaacaatgttatgaatatgtttgaataaatgatggagacacatgtgactttccgattagaatatgactacataaaaaaattagctttgagtctatggataagatcacaaagggatctcttaacatatgtttttatggatgtagtgttagttgatgaaagctaagcacgagtaaatggaaaactagagttgtcgtgggagattctagagtttaaaggttttggacgattttggactcgatcagtagaactcaaattgaatataaaagatgtgatttcaacactactacatatgaggaaagacatgttagtttgaaaaatcaagtagtgtccggaaggacatctttagatatttagaatctatgctactacatatgaggaaagacatgttagtttgaaaaatcaagtagtgttctgaaaggacatctttagatatttaggatctatgcatagatatttaggatctatgcatagatatttaggatctatgctacgaaaggctacgtagagatagtgataaaggtattagtcaaaggatgaggtggcgccaaacatttgatgttctatatgacaataggataccacaaaagttaaaaagaatctttataggatgacaattcgatctgctatattgttcggtgcagaatgttagtctaaaaaagacatgttcaatacgtatgcgctacagaaatgtatatgttgtgttggagtttggccataaaaaaggatcgagtatgaaacgaggatacatatgatagactagatgtaacatcggtgcgagtatgaaacgaggatacatatgatagactagatgtaacatcggtgcgaagaaaagctcatccagcatcggttaaaatggtttagac

SEQ ID NO: 19 - DNA, 577 bp, Zea mays
actcgatccttcctcttcctcaaccgtgcgggcgatcgatcgcaccgccccctcgcccgaccccatgccttccacgtcgcggtcggggtagggctcaggagacgttctcttggtgtggagagtggcattgattcttcgatgctcgggcaggaaggctgggctggggatgagaacgctggagatggaagggccgaggaggtgaggagaattaacataaatgaggcagcacatgctacagatggcactggtagggttaatgttagcggtgctggcggagttgaagatatcggcaactttcatatcgatgttgatgcatccgaggatatattggggaatttgcacaacatgcacttcttgagggtggacaatcttggacggatgatttaactgttgttatggtttactggggctatgattagccaggccgactcttgctgttcaagtgttcatttgagtgtaattgttccatccctgttatgtaatgttgtagttgtagacttgtagtctacctggtacctgtagttacttaacatcaggcagggaaaaatttgtatgttcattaaaaaaaaaaaaaaaa

SEQ ID NO: 20 - DNA, 4090 bp, Zea mays
cacactcactcgtcggcttagggaccccccggtctcgaaacgccgacactactcttgaggagattattagattatcataatctaggctttagattatataatctgaacacataatctagttgtttgtttatctaatggattatttacgctagattatataatctggagagattataatctgaaacaaacatggccttagtgattaaaaataaaaataaggggtaaaatcacaattgtaaagtgagagaaggctataatcacaattaaccataaaaagttaatattattttcaggttaattttgagtatatccttctcttcccttacagttatgattttaccccttatttttaatttttgtaatcaataattcacaaagttgaaaacgtataatcacagttgtccttaaaattaaatgtgctgcccaacaaaatactctcggactgacagacagtcgccagtcaagagcccctcgggcagcaggatcttccccctccccaaaaccaaaccagctgcctccgacagcatccaccttttcctcccccaaaccatggacttctccaccggcgggagcgtgagcgggggcggcggaggcgccagcgacggccccgcgcaggcggagcgctggctggagatcgccgagaagctcctcgcggcgcgcgacctcgtcggctgcaagcgcttcgcggagcggtcggtggaggcgaacccgctcctcgccggcgttgacgaactcctcgccgtcgccgacgtcctcctcgcttcccagttcatgggcacctcgggccagccggacccgctcgccatcctccagctgccgcccggagtcagccccgaccaggccgccgtgtcccgcgccttccgccgcctcgcgctcctcctcggtcccagcaacccgcacccgggagccgagatggcgctccgcctcgtcaacgacgcctacgccttcctctcggatccctctcgccgccccccgccgcccgccgatcccgccactggtaccccttactcctcccagtatcccgccgcggccgctcccgcctccgacaccccggagttctggacggcgtgccccttctgctgctacgtgcaccagtacccgcgcagcctgatcgggcgcgccctcaagtgccccaacgcgggctgccgccgcggattcgtggcttctgagctcccgaccccacccacggttgtgccgggcactgaaatgtaccactgcgcctgggggttcttccccctcggatttcccaacgcggccgacctgggtgccaactggaagccattctacaagatgttcccttggaacacggctcccagtggccaaggtggtggtggtaggagtcacggaaaccatggtggtaggcagccacagaatgacagtgctcgtggtggctcttctagaggtaggatcaagaagacgacggcccgcaagaaggtcggggtagggctcaggagacgttctcttggtgtggagagtggcattgattcttcgatgctcgggcaggaaggctgggctggggatgagaacgctggagatggaagggccgaggaggtgaggagaattaacataaatgaggcagcacatgctacagatggcactggtagggttaatgttagcggtgctggcggagttgaagatatcggcaactttcatatcgatgttgatgcatccgaggatatattggggaatttgcacaacatgcacttcttgagggtggacaatcttggacggatgatttaactgttgttatggtttactggggctatgattagccaggccgactcttgctgttcaagtgttcatttgagtgtaattgttccatccctgttatgtaatgttgtagttgtagacttgtagtctacctggtacctgtagttacttaacatcaggcagggaaaaatttgtatgttcattagatggagatacatgccatttgccttagcaaacacactttgtggaggtttccagtgatgggataatgcttcgcagaggtgtggttggactggcaatgcttaccatgccacttctggtttcttcctggcatggtgacacaaaatgttgttgagatcaagtaagtgaattatgttctgctttctgagttcggtaaacttctttggctacaaaaggactaagcttagttatgctaacttgttgatttggttgtgatcattgcatcattctgctgtgtgaattgatacttaatacctctgattttttatagcctgcttacaattacatatgttacctaatgagatatattccattttccattgattctgttaacaatattcataccactttggtcgtgataaattcatttgactattgtatagaagtcatatatgtctacatgtgaagtgaatgatccattatcagatacacatgaattctcatagtgttgcttgatatgtcaccgtttaagtttgctcctacagaagataggattcgatgattacatgtaacaaagattagttgtgattttgtctattaattggatgagatattatcttgaagcaaaaggtcatcgagaaccataaaaaatgggttaatcccacagcagactagtactgtccgctaaatacaagtgcttacctttcctggaccatttaatctttgaaacacacgcagaacttgttatagataatctttgtgatagcatggaatagaaatcattgacttgggtgcctaacatagcaagcaattgacgattttgagttactcatgtccatttttgctgagtatccatattaatgcagacggccatagttcattttcgtgtcgttatttttcattgagatagaacaaaacagcgacttctcttggggagtacacttattaccaacgctggcatcctgttatctagtttaatctgaacctgttcttgaaaactgtgtttcagaaagtcacttgccttggtttgttctataatattcttctgtgctatgagctatggtaagcaaaatatttcgaattttaaagcagttttctaaatgatgcaaaggcagattggtttgagattgcacatctacagaattcttttgactaacatcttatcttagccaagcagtagttaagattaactgttttactcaccaagtagaactcttcaaagctcagactaagcattttgtggtttcttactaactcctttgtttggcaacccgcagtgggttgtccataccatgccctgaatgaagcaaagtttcttggccgattggcccagcttagtggggatatcagcagccctagcctgaagggccaattccttttactgttttttttatccctattttttgaggaagcaaagttccaacaacaatgttatgaatatgtttgaataaatgatggagacacatgtgactttccgattagaatatgactacataaaaaaattagctttgagtctatggataagatcacaaagggatctcttaacatatgtttttatggatgtagtgttagttgatgaaagctaagcacgagtaaatggaaaactagagttgtcgtgggagattctagagtttaaaggttttggacgattttggactcgatcagtagaactcaaattgaatataaaagatgtgatttcaacactactacatatgaggaaagacatgttagtttgaaaaatcaagtagtgtccggaaggacatctttagatatttagaatctatgctactacatatgaggaaagacatgttagtttgaaaaatcaagtagtgttctgaaaggacatctttagatatttaggatctatgcatagatatttaggatctatgcatagatatttaggatctatgctacgaaaggctacgtagagatagtgataaaggtattagtcaaaggatgaggtggcgccaaacatttgatgttctatatgacaataggataccacaaaagttaaaaagaatctttataggatgacaattcgatctgctatattgttcggtgcagaatgttagtctaaaaaagacatgttcaatacgtatgcgctacagaaatgtatatgttgtgttggagtttggccataaaaaaggatcgagtatgaaacgaggatacatatgatagactagatgtaacatcggtgcga

SEQ ID NO: 21 - DNA, 10452 bp, Zea mays
tgcggatagacttcagaggaaaggactaccgcacccggtggtttgtccattatgtgatcaagagcaggaaactatcttgcacctcttgtgctcttgcagtttcgctagacaattttggcatgttatattttcagctttgaggatgggccatcttacgcctactagagaggcgggctcttttgtggattggtgggaaaaggtgcataggagagtccccaaacatatcagaaaaaggttttcatagtctcattatcctaggggcctggtgtttatggctacatcgcaataaggcggtttttgatggtgtcaacccttcattgagcaccattcagaggcttttcatggatgaggtggaatgctggtatatggctggtgcaaagcagctcgagagtctcggacttctggctgcttttgctaggatcagggctattcctagtgcatgaggctgtactatttttcctttttattttttgcctgcttggctttgtactttggtccatttcggacctttctctctttcaatataatgatgcgcagttttcctgcgtgttcgagaaaaaaaaatataaacttctctctatagtaacctagcataagtgcactcaaagaaaatatgtatcagatggtttgtggctcaaaagagcaagttgtgtcactatttcaatttctttttgataaaattaccttttgtgagattgtgagaatgaccctctttttttgaaagaactacatgaagatttttatctttaaaggtatctttagacaccaaattattcataaaacattaattccattagtaactaagaatttatacatataattaatagaaaagataccatctttatgcaagtgccaaacaaacacgttagattcttgttttagcaatttagcttgccatgatttttatttaggtaagattcgaaaaccctttgttttgggcctttcctccctaaccacccccacatacactccatcatatttttacttttccaagttttgtttggtttataaaatagaatgaaataatctgccattactttattcctcacaatctaataattactactagtaagataagagataattgtgattatacccttcgttggccttgcaattgtgattttactctgcattttcaactttctaattttacacctccgttttaaatacgaagctaccatttgcccttcactctcaacatcgttagtgaaaatcagaattagtgattaaaaataaaaaaatgagaaaataaatgggtgaaaggttcaaactacctttttctattctttatgggcacaaccctaataggggtgaaatcactattacataatataacgagggtaaaatcaaaataaattgcttgggtatttttatcttttgcatcaaatttaacattgttaactgcatctaacggcacaagggtatggcaactcttcgttttcaaaatgaagggataaaatatcacaaagttgaaaaacgatgggtaaaatcacaatttcaagaccagagagggtataatcacaaataccctataagataaatagagtcattatatcattttttgtaagatatacttggggatacatcaactcatccttagagtttgtttgggactgtgcggctctatatttcaaccaaacaagtgtagctaaaaaaggtgaagttaaaagagaagtactctagaaactctaaattaaatttagagaaaattcctggtatgccatcaaattttatactcattccttgtgtgccactgagtggcatataggtatattttttggtgtctatgacatgtggggtcagtggcatacaaggaatgagtatattttctagtggcatacagggaattggcccttaaatttatggagtagattttgaggatagatctaaccaggcttgatgatgacatgtcactgtattacaacattgatgaagatctttcacttgaggaaaatactattgtgcaaccaaacattctatacaatccaactatcaaaagtcacaaaaatatttaaaaaattatacatatatattatttactttatcaatatatcatatttaagatcctagattgatttatgctatgttaatatataattcattcatcttatataacaaggtatatatttttggtacagtctttggagcgaaactttgactatttgtttatttcaaaatatgctatcaataaaaacataacgagcattaaattaaagtaatttttgaatacaaatcaagtatataacatgtatatactaaaatatatgcttttggctgaattactagtcaaaagttttaaaacattgagtcttttttttttaaaatgcaggccttattttacggaattgagggaattttttttatctaattgaatatattttttcttttactattgtataaatttaaacttaaaattttataatctaataaagtaaacaataaattatatttatatatttttagaattttttatggtttttggtagtccaattatacattgattgtatgcaaaacttgctctgcggtggggcgctacaatggtctggtatgtttgcatatgggaaaactaatagcccgttcccttggttttaattcgaaacggcttttactatttctgtagtgttttggtctctgtgaattgcagctacaataatctaaacaactgactttaattcgaagctaacaggctataagacgctctccaacggatcctttcccctccccttcacgacgtattcggtgatttcgtacatcgagagagcttcaacaggtccctctcctccctcttgtagggtgagagaaggaaaacaccttgtaaaacgagaaagatagaaccctactcttcactaattagtgtttttaactataaaattaatctgctataagtttggttaagtgacaatgtgtattatgatattataaatattaaaaactctaaaaactgatgtagaaaagtcaaatagcttagttaaagggtaaagggagagctgaatagagggatgcttggagaggaggtaaaatagggaaataatagtgaagatgaggatatttaaatatgaatagaaagtccaaatgtgggatttgagatggagaatgattggagagagcctaataaaatcaagggataattgtgattatacccttttctaatattttaattgtgattttatcccttcttttttaactttgttacccctctgttttgaaaacaaagccgttgtttgcaccgccttatcaacgttaataaaaatcagaattagtgattaaaaataaaaataaggggtaaaatcacaattgtaaagtgagagaaggctataatcacaattaaccataaaaagtttaatattattttcagattaattttgagtatatccttctcttcccttacaattatgattttacccctcatttttaattttcgtaatcaataattcacgaagttgaaaacgtataatcacagttgtccttaaaataaatgtgctgcccaacaaaatactctcggactgacagacagtcgccagtcaagagcccctcgggcagcaggatcttccccctccccaaaaccaaaccagctgcctccgacagcatccaccttttcctcccccaaaccatggacttctccaccggcgggagcgtgagcgggggcggcggaggcgccagcgacggccccgcgcaggcggagcgctggctggagatcgccgagaagctcctcgcggcgcgcgacctcgtcggctgcaagcgcttcgcggagcggtcgatggaggcgaacccgctcctcgctggcgttgacgagctcctcgccgtcgccgacgtcctcctcgcttcccagttcatgggcccctcgggccagccggacccgctcgccatcctccagctgccgcccggagtcagccccgaccaggccgccgtgtcccgcgccttccgccgcctcgcgctcctcctcggccccagcaacccgcacccgggagccgagatggcgctccgcctcgtcaacgacgcctacgccttcctctcggatccctctcgccgccccccgccgcccgccgatcccgccactggtaccccttactcctcccagtatcccgccgcggccgctcccgcctcggacaccccggagttctggacggcgtgccccttctgctgctacgtgcaccagtacccgcgcagcctgatcgggcgcgccctcaagtgccccaacgcgggctgccgccgcggattcgtggcttctgagctcccgaccccacccaccgttgtgccgggcactgaaatgtaccactgcgcctgggggttcttccccctcggatttcccaacgcggccgacctgggtgccaactggaagccattctacaagatgtttccttggaacacggctcccagtggccaaggtggtggtggtaggagtcacggaaaccatggtggtaggcagccacagaatgacagtgctcgtggtggctcttctagaggtaggatcaagaagacgacggcccgcaagaaggtcggggtagggctcaggagacgttctcttggtgtggagagtggcattgattcttcgatgctcgggcaggaaggctgggctggggatgagaacgctggagatggaagggccgaggaggtgaggagaattaacataaatgaggcagcacatgctacagatggcactggtagggttaatgttagcggtgctggcggagttgaagatatcagcaactttcatatcgatgttgatgcatctgaggatatattggggaatttgcacaacatgcacttcttgagggtggacaatcttggacggatgatttaactgttgttatggtttactggggctatgattagccaggccgaagcagatgtctcagagactggctcttgctgttcaagtgttcatttgagtgtaattgttccatccctgttatgtaatgttgtagttgtagacttgtagtctacctggtacctgtagttacttaacatcaggcagggcaaaatttgtatgttcattagatggagatacatgccatttgccttagcaaacacgctttgtggaggtttccagtgatgggataatgcttcacagaggtctggttggactggcaatgcttaccatgccacttctggtttcttcctggcatggtgacacaaaatgttgttgagatcaagtaagtgaattatgttctgctttctgagttcggtaaacttctttggctacaaaaggactaatcttagttatgataacttgttgacttggttgtgatcattgcatcattctgctgtctgaattgatacttaatacctctgattttttatagcctgcttacaattccatatgttacctaatgagatatattccattttccattgattctgttaacaatattcataccacttttgtagtcatatatgtctacatgtgaagtgaatgatcctttatcagatacacatgaattctcatagtgttgcttgatatgtcaccgtttaagtttgctcctacagaagataggattcgatgatgacatgtaacaaagattacttgtgattttgtctattaattggatcagatattatcttgaagcaaaaggccatcgagaaccataaaaaatgggttaatcccacagcagactagtactgtccgctaaatacaagtgcttacctttcatggatcatttaatgtttgaaacacactcagaacttgttatagataatctttgcgatatcatggaatataaatcattgacttgggtgcttaacatagcaagcacttgacgattttgagttactcatgtccatttttgctgcgtatccatattaatgcagacggccatagttcatttttgtgtcgttatttttcattgagaaagaacaaaacagtgacttctcttggggagtagacttattaccaacgctggcatcctgttatctagtttaatctgaacctgttcttgaaaactgtgtttcagaaagtcacttgccttggtttgttctataatattcttctgtgctatgagctattgtaagcaaaatatttcgaattttaaagcagttttctaaatgatgcaaaggcagattggtttgagattgcacatctacagaattcttttagctaacatcttatcttagccaagcagtagttaagattaactgttttactcaccaagtagaactcttcaaagctcagactaagcattttgtggtttcttactaacttctttgtttggcaatccgcagtgggttgtccatatcatgccctgaatgaagcaaagtttcttggccgattggcccagcttagtggggatatcagcagctctagcctgaagggccaattccttttactgttttttatccctgttttttgaggaagcaaagttccaacaacaatgttatgaatatgtttgaataaatgatggagacacatgtgacttttcgattagaatatgactacataaaaaattagctgagtctatggataagatcacaaagggatatctcttaacatatgttttttatggatgtagtgttagttgatgaaagctaagcacgagtaaatagaaaactagagttgtggtgggagattctagagtttaaaggttttggacgattttggactcgatcagtagaactcaaattgaatataaaagatgtgatttcaacactactacatatgaggaaagacatgttagtttgaaaaatcaagtagtgtccaggaaggacatctttagatatttaggatctatgctactacatattaggaaagacatgttagtttgaaaaatcaagtagtgtccatgaaggacatctttagatatttaggatctatgctacgtagagatattgataaaggtattagtcaatggatgaggtagcgccaaacatttgatattctatatgacaataggataccacaaaagttaaaaagaagttttataggatgacaattcgatctgctatgttgttcggtgcaaaatgttagtctaaaaaagacatgttcaatacatatgcgctacagaaatgcatatgttgtgttggagtttggccataaaaaaggatcgagtatgaaacgacgatacatatgatagactagatgtaacaccggtgcgaagaaaacctcatccaacatcggttgaaatggtttagacatatcaataaagactttcagatgcaccaataattccttcttcgctttcctttcttccttttttttatcacaaacaagttaaagaacacggctctctttgatcctctgtattgaagctactagtttgctacgaaaattgaaaagcatcatataaacatgtatgcttgcgacctttaggtacataagaatgcaacctcaataataccaaacgaatcgcctcaccaatcaccaccaccacaggagcaaccagccaaacatttcttgcagcactctgggcgacctggaacgataatcccggaatgcagcaaatggctgcttacgcgatacgaaggaagcggtcctatccaatgctttgttctttaacaaattcaccccattctaaatttgtccagctacgccagcacgagcctgcagtgtctcggtacgtttgcttttttccatttgttccaccagccagtctatgccagatttgatccccctcctgcaagagccggtgtcacatttaaacaatataacagatctttagaatatcatgcacccaggaaacaatataacagacgaatgtgtgaatttttttgtatctttgagtaaaattgtcatttttttcatggcgagtcaaatttcctcaggaaccagttgagtttctgcgctcacccatcatatgcagatacagcctgaaatgtatatgtcctctcatccagttctttatgcagaaatttagccaattcttcctcatcaatggctccaggtaaatcctgccaaaagaaatccagaagcaccctccaaacatgagaacaagctagaggtaaataataaacaatttgatagaataatgtgtacccagcttaacagaaacagacagtgcatgtagtcattggtttccatgtgatcttttcaggaagttttaattgatttaaaaactacatctggtattcaacctcgcaatggcgcataggcgctttgcaacgtaggaatttatatttgtatgcctcacagcatgtgcacatgacaaaaacaaaatctttattttaactacgatggcaactttattgtaagcactaaatctttcaatcataattatgtactgtggtacaaaatatagaaagtggaagtaaacccttcacctgtttgtttgcaactatcaagagtggtgctcctctcagatgttcatggcgaataaccttctctgaagtaagaaatttaggttaggttctctagaatgagttctcatcccatttaccagagaggcattgcatcttctggaaagatctagcaatagaaacaaaccagtactccctctgttccaagttataagacgatgttttagcttttctagatatattgttttaactatgtaccaggacattatatatatttttaatatttaagtccatagcaaaatttatttatctagaaaaaggccaaaatgtcttataatttggaatggatggcgtagtttataattgacacaaataagaaccttacccaaagcagatttggaatcttcaaatgacgatgctgtggcagcgtcaataacgtacattatggcatgggcctcttcatagtatttctcccagattgttcgtaggctaacctgccaagcaggcaagtgtgtaagaaatactgaacttggcatggaagcttaattatcatactagcaagcagtgatactgaagttagttttacactaattcttataacatagcagagaagctgatgctgttctactagccacccaattctattgagtactgtgaatgttagccaacagagcatatctttgctttctgaaaattctattgagcattccatataactagattatatatattctgctggaacgcaaaaagatgctaggttaataactaaagcaaccacatcctagtaatttgattttatgacatgtatttcccaggcattagaaaccctgatatagcaccaaactgacaagactcaaatatcaacgatcgtagggtggtgccacggcaacagaaggctcactttactacgtacgtaaacgttcttacctgaccacctagatcccagaaaacaagttttgcctttgcgtcttcgatgcggccaatgttgagcccaactgttggaacgacacggtcaggcggaagtccttcccccttgagatatatcgatttcaacttctccagcaaagtctatggcaacggttccagaaacattgtgtacaggtaagtttcatcaatttctagttcagaaagggaaatatatatatatgaaggctgggagctagcagctaccgtcttgccagctctgtcaacaccaagaatcagaacacggaactcgtccttggcgaacacatacttccacaggccatagaacaaggagaacatttccgcttatatatatatatccggcgataagcaaccgccagcacgttacgtcctgaaaaacgaatcatacgttacaaacattttctccgatcagtaacagtacgcagccaaaagcatgtacgccccaaattgccagacgcaaaactaggaaccatcctcatagtacagggccgcagcatttcaatccacaacgaaatggtatcgaccgagtaaaaataaggggagaggatataacttaactgaaccatcgggcgggagagtacaactacagactacagaggggagaggatgttgagatctagatagctcaccggagcgctcgaaggctccttgatcgcgccgcttcagacgacaccacccgctcccgtgtggactggagcgcgggaggctgagggcgggttttgagccgcgcggcggtgggagcgcgcccaccggagttaggaactggggcactcgcctcgccagtcgccacacggcttgggttcggttgactcgatgggcgtcacggtgggcgacttggaactggaacccacgcaggagcaggacccgtggggctatgatcggtgggtcctgcaggattctgggacgggaggccctaccgctcagtgaggttatcgtactgccagtgggaattcgtgatgtgactgtaccagtggttgacccggaaggaaggcactggctggcaggagggctttgccattaataaaaacataaattattgcatctgacaagtttagtggagagctaacggtgccaaatgttgcgcttgcctttctacctgcagtcagtcctattcagcccagctcatttagcccggtctcggactctcggcccacatggcagcccataccatgacactctccacctctcgaaatgtcagcccataccatgacattcacttaaggggtgtttgaatgcactagagctaatagttagtagctaaaattagttgagacatccaaa

SEQ ID NO: 22 - DNA, 6816 bp, Zea mays
tgtcccgcgcctcccgccgcctcgcgctcctcctcggccccagcaacccgcacccgggagccgagatggcgctccgcctcgtcaacgacgcctacgccttcctctcggatccctctcgccgccccccgccgcccgccgatcccgccactggtaccccttactcctcccagtatcccgccgcggccgctcccgcctcggacaccccggagttctggacggcgtgccccttctgctgctacgtgcaccagtacccgcgcagcctgatcgggcgcgccctcaagtgccccaacgcgggctgccgccgcggattcgtggcttctgcgacgcgggctgccgccgcggattcgtggcttctgagctcccgaccccacccaccgttgtgccgggcactgaaatgtaccactgcgcctgggggttcttccccctcggatttcccaacgcggccgacctgggtgccaactggaagccattctacaagatgtttccttggaacacggctcccagtggccaaggtggtggtggtaggagtcacggaaaccatggtggtaggcagccacagaatgacagtgctcgtggtggctcttctagaggtaggatcaagaagacgacggcccgcaagaaggtcggggtagggctcaggagacgttctcttggtgtggagagtggcattgattcttcgatgctcgggcaggaaggctgggctggggatgagaacgctggagatggaagggccgaggaggtgaggagaattaacataaatgaggcagcacatgctacagatggcactggtagggttaatgttagcggtgctggcggagttgaagatatcagcaactttcatatcgatgttgatgcatctgaggatatattggggaatttgcacaacatgcacttcttgagggtggacaatcttggacggatgatttaactgttgttatggtttactggggctatgattagccaggccgaagcagatgtctcagagactggctcttgctgttcaagtgttcatttgagtgtaattgttccatccctgttatgtaatgttgtagttgtagacttgtagtctacctggtacctgtagttacttaacatcaggcagggcaaaatttgtatgttcattagatggagatacatgccatttgccttagcaaacacgctttgtggaggtttccagtgatgggataatgcttcacagaggtctggttggactggcaatgcttaccatgccacttctggtttcttcctggcatggtgacacaaaatgttgttgagatcaagtaagtgaattatgttctgctttctgagttcggtaaacttctttggctacaaaaggactaatcttagttatgataacttgttgacttggttgtgatcattgcatcattctgctgtctgaattgatacttaatacctctgattttttatagcctgcttacaattccatatgttacctaatgagatatattccattttccattgattctgttaacaatattcataccacttttgtagtcatatatgtctacatgtgaagtgaatgatcctttatcagatacacatgaattctcatagtgttgcttgatatgtcaccgtttaagtttgctcctacagaagataggattcgatgatgacatgtaacaaagattacttgtgattttgtctattaattggatcagatattatcttgaagcaaaaggccatcgagaaccataaaaaatgggttaatcccacagcagactagtactgtccgctaaatacaagtgcttacctttcatggatcatttaatgtttgaaacacactcagaacttgttatagataatctttgcgatatcatggaatataaatcattgacttgggtgcttaacatagcaagcacttgacgattttgagttactcatgtccatttttgctgcgtatccatattaatgcagacggccatagttcatttttgtgtcgttatttttcattgagaaagaacaaaacagtgacttctcttggggagtagacttattaccaacgctggcatcctgttatctagtttaatctgaacctgttcttgaaaactgtgtttcagaaagtcacttgccttggtttgttctataatattcttctgtgctatgagctattgtaagcaaaatatttcgaattttaaagcagttttctaaatgatgcaaaggcagattggtttgagattgcacatctacagaattcttttagctaacatcttatcttagccaagcagtagttaagattaactgttttactcaccaagtagaactcttcaaagctcagactaagcattttgtggtttcttactaacttctttgtttggcaatccgcagtgggttgtccatatcatgccctgaatgaagcaaagtttcttggccgattggcccagcttagtggggatatcagcagctctagcctgaagggccaattccttttactgttttttatccctgttttttgaggaagcaaagttccaacaacaatgttatgaatatgtttgaataaatgatggagacacatgtgacttttcgattagaatatgactacataaaaaattagctgagtctatggataagatcacaaagggatatctcttaacatatgttttttatggatgtagtgttagttgatgaaagctaagcacgagtaaatagaaaactagagttgtggtgggagattctagagtttaaaggttttggacgattttggactcgatcagtagaactcaaattgaatataaaagatgtgatttcaacactactacatatgaggaaagacatgttagtttgaaaaatcaagtagtgtccaggaaggacatctttagatatttaggatctatgctactacatattaggaaagacatgttagtttgaaaaatcaagtagtgtccatgaaggacatctttagatatttaggatctatgctacgtagagatattgataaaggtattagtcaatggatgaggtagcgccaaacatttgatattctatatgacaataggataccacaaaagttaaaaagaagttttataggatgacaattcgatctgctatgttgttcggtgcaaaatgttagtctaaaaaagacatgttcaatacatatgcgctacagaaatgcatatgttgtgttggagtttggccataaaaaaggatcgagtatgaaacgacgatacatatgatagactagatgtaacaccggtgcgaagaaaacctcatccaacatcggttgaaatggtttagacatatcaataaagactttcagatgcaccaataattccttcttcgctttcctttcttccttttttttatcacaaacaagttaaagaacacggctctctttgatcctctgtattgaagctactagtttgctacgaaaattgaaaagcatcatataaacatgtatgcttgcgacctttaggtacataagaatgcaacctcaataataccaaacgaatcgcctcaccaatcaccaccaccacaggagcaaccagccaaacatttcttgcagcactctgggcgacctggaacgataatcccggaatgcagcaaatggctgcttacgcgatacgaaggaagcggtcctatccaatgctttgttctttaacaaattcaccccattctaaatttgtccagctacgccagcacgagcctgcagtgtctcggtacgtttgcttttttccatttgttccaccagccagtctatgccagatttgatccccctcctgcaagagccggtgtcacatttaaacaatataacagatctttagaatatcatgcacccaggaaacaatataacagacgaatgtgtgaatttttttgtatctttgagtaaaattgtcatttttttcatggcgagtcaaatttcctcaggaaccagttgagtttctgcgctcacccatcatatgcagatacagcctgaaatgtatatgtcctctcatccagttctttatgcagaaatttagccaattcttcctcatcaatggctccaggtaaatcctgccaaaagaaatccagaagcaccctccaaacatgagaacaagctagaggtaaataataaacaatttgatagaataatgtgtacccagcttaacagaaacagacagtgcatgtagtcattggtttccatgtgatcttttcaggaagttttaattgatttaaaaactacatctggtattcaacctcgcaatggcgcataggcgctttgcaacgtaggaatttatatttgtatgcctcacagcatgtgcacatgacaaaaacaaaatctttattttaactacgatggcaactttattgtaagcactaaatctttcaatcataattatgtactgtggtacaaaatatagaaagtggaagtaaacccttcacctgtttgtttgcaactatcaagagtggtgctcctctcagatgttcatggcgaataaccttctctgaagtaagaaatttaggttaggttctctagaatgagttctcatcccatttaccagagaggcattgcatcttctggaaagatctagcaatagaaacaaaccagtactccctctgttccaagttataagacgatgttttagcttttctagatatattgttttaactatgtaccaggacattatatatatttttaatatttaagtccatagcaaaatttatttatctagaaaaaggccaaaatgtcttataatttggaatggatggcgtagtttataattgacacaaataagaaccttacccaaagcagatttggaatcttcaaatgacgatgctgtggcagcgtcaataacgtacattatggcatgggcctcttcatagtatttctcccagattgttcgtaggctaacctgccaagcaggcaagtgtgtaagaaatactgaacttggcatggaagcttaattatcatactagcaagcagtgatactgaagttagttttacactaattcttataacatagcagagaagctgatgctgttctactagccacccaattctattgagtactgtgaatgttagccaacagagcatatctttgctttctgaaaattctattgagcattccatataactagattatatatattctgctggaacgcaaaaagatgctaggttaataactaaagcaaccacatcctagtaatttgattttatgacatgtatttcccaggcattagaaaccctgatatagcaccaaactgacaagactcaaatatcaacgatcgtagggtggtgccacggcaacagaaggctcactttactacgtacgtaaacgttcttacctgaccacctagatcccagaaaacaagttttgcctttgcgtcttcgatgcggccaatgttgagcccaactgttggaacgacacggtcaggcggaagtccttcccccttgagatatatcgatttcaacttctccagcaaagtctatggcaacggttccagaaacattgtgtacaggtaagtttcatcaatttctagttcagaaagggaaatatatatatatgaaggctgggagctagcagctaccgtcttgccagctctgtcaacaccaagaatcagaacacggaactcgtccttggcgaacacatacttccacaggccatagaacaaggagaacatttccgcttatatatatatatccggcgataagcaaccgccagcacgttacgtcctgaaaaacgaatcatacgttacaaacattttctccgatcagtaacagtacgcagccaaaagcatgtacgccccaaattgccagacgcaaaactaggaaccatcctcatagtacagggccgcagcatttcaatccacaacgaaatggtatcgaccgagtaaaaataaggggagaggatataacttaactgaaccatcgggcgggagagtacaactacagactacagaggggagaggatgttgagatctagatagctcaccggagcgctcgaaggctccttgatcgcgccgcttcagacgacaccacccgctcccgtgtggactggagcgcgggaggctgagggcgggttttgagccgcgcggcggtgggagcgcgcccaccggagttaggaactggggcactcgcctcgccagtcgccacacggcttgggttcggttgactcgatgggcgtcacggtgggcgacttggaactggaacccacgcaggagcaggacccgtggggctatgatcggtgggtcctgcaggattctgggacgggaggccctaccgctcagtgaggttatcgtactgccagtgggaattcgtgatgtgactgtaccagtggttgacccggaaggaaggcactggctggcaggagggctttgccattaataaaaacataaattattgcatctgacaagtttagtggagagctaacggtgccaaatgttgcgcttgcctttctacctgcagtcagtcctattcagcccagctcatttagcccggtctcggactctcggcccacatggcagcccataccatgacactctccacctctcgaaatgtcagcccataccatgacattcacttaaggggtgtttgaatgcactagagctaatagttagtagctaaaattagttgagacatccaaacactttagttaatagttcaactattagctatttttggtaaattagttaatagttagatagttatttgttagctagctaattccactaccaatttttagccaactaactattagttctagtgcattcaaacacccccttagcctggtcttaacagagtagaagagatgtcagcaccgacaacctgaaacctttgctactcaagtgcaattgatggacaagtgctttccttgttcttcg

SEQ ID NO: 23 - DNA, 3904 bp, Zea mays
tgcggatagacttcagaggaaaggactaccgcacccggtggtttgtccattatgtgatcaagagcaggaaactatcttgcacctcttgtgctcttgcagtttcgctagacaattttggcatgttatattttcagctttgaggatgggccatcttacgcctactagagaggcgggctcttttgtggattggtgggaaaaggtgcataggagagtccccaaacatatcagaaaaaggttttcatagtctcattatcctaggggcctggtgtttatggctacatcgcaataaggcggtttttgatggtgtcaacccttcattgagcaccattcagaggcttttcatggatgaggtggaatgctggtatatggctggtgcaaagcagctcgagagtctcggacttctggctgcttttgctaggatcagggctattcctagtgcatgaggctgtactatttttcctttttattttttgcctgcttggctttgtactttggtccatttcggacctttctctctttcaatataatgatgcgcagttttcctgcgtgttcgagaaaaaaaaatataaacttctctctatagtaacctagcataagtgcactcaaagaaaatatgtatcagatggtttgtggctcaaaagagcaagttgtgtcactatttcaatttctttttgataaaattaccttttgtgagattgtgagaatgaccctctttttttgaaagaactacatgaagatttttatctttaaaggtatctttagacaccaaattattcataaaacattaattccattagtaactaagaatttatacatataattaatagaaaagataccatctttatgcaagtgccaaacaaacacgttagattcttgttttagcaatttagcttgccatgatttttatttaggtaagattcgaaaaccctttgttttgggcctttcctccctaaccacccccacatacactccatcatatttttacttttccaagttttgtttggtttataaaatagaatgaaataatctgccattactttattcctcacaatctaataattactactagtaagataagagataattgtgattatacccttcgttggccttgcaattgtgattttactctgcattttcaactttctaattttacacctccgttttaaatacgaagctaccatttgcccttcactctcaacatcgttagtgaaaatcagaattagtgattaaaaataaaaaaatgagaaaataaatgggtgaaaggttcaaactacctttttctattctttatgggcacaaccctaataggggtgaaatcactattacataatataacgagggtaaaatcaaaataaattgcttgggtatttttatcttttgcatcaaatttaacattgttaactgcatctaacggcacaagggtatggcaactcttcgttttcaaaatgaagggataaaatatcacaaagttgaaaaacgatgggtaaaatcacaatttcaagaccagagagggtataatcacaaataccctataagataaatagagtcattatatcattttttgtaagatatacttggggatacatcaactcatccttagagtttgtttgggactgtgcggctctatatttcaaccaaacaagtgtagctaaaaaaggtgaagttaaaagagaagtactctagaaactctaaattaaatttagagaaaattcctggtatgccatcaaattttatactcattccttgtgtgccactgagtggcatataggtatattttttggtgtctatgacatgtggggtcagtggcatacaaggaatgagtatattttctagtggcatacagggaattggcccttaaatttatggagtagattttgaggatagatctaaccaggcttgatgatgacatgtcactgtattacaacattgatgaagatctttcacttgaggaaaatactattgtgcaaccaaacattctatacaatccaactatcaaaagtcacaaaaatatttaaaaaattatacatatatattatttactttatcaatatatcatatttaagatcctagattgatttatgctatgttaatatataattcattcatcttatataacaaggtatatatttttggtacagtctttggagcgaaactttgactatttgtttatttcaaaatatgctatcaataaaaacataacgagcattaaattaaagtaatttttgaatacaaatcaagtatataacatgtatatactaaaatatatgcttttggctgaattactagtcaaaagttttaaaacattgagtcttttttttttaaaatgcaggccttattttacggaattgagggaattttttttatctaattgaatatattttttcttttactattgtataaatttaaacttaaaattttataatctaataaagtaaacaataaattatatttatatatttttagaattttttatggtttttggtagtccaattatacattgattgtatgcaaaacttgctctgcggtggggcgctacaatggtctggtatgtttgcatatgggaaaactaatagcccgttcccttggttttaattcgaaacggcttttactatttctgtagtgttttggtctctgtgaattgcagctacaataatctaaacaactgactttaattcgaagctaacaggctataagacgctctccaacggatcctttcccctccccttcacgacgtattcggtgatttcgtacatcgagagagcttcaacaggtccctctcctccctcttgtagggtgagagaaggaaaacaccttgtaaaacgagaaagatagaaccctactcttcactaattagtgtttttaactataaaattaatctgctataagtttggttaagtgacaatgtgtattatgatattataaatattaaaaactctaaaaactgatgtagaaaagtcaaatagcttagttaaagggtaaagggagagctgaatagagggatgcttggagaggaggtaaaatagggaaataatagtgaagatgaggatatttaaatatgaatagaaagtccaaatgtgggatttgagatggagaatgattggagagagcctaataaaatcaagggataattgtgattatacccttttctaatattttaattgtgattttatcccttcttttttaactttgttacccctctgttttgaaaacaaagccgttgtttgcaccgccttatcaacgttaataaaaatcagaattagtgattaaaaataaaaataaggggtaaaatcacaattgtaaagtgagagaaggctataatcacaattaaccataaaaagtttaatattattttcagattaattttgagtatatccttctcttcccttacaattatgattttacccctcatttttaattttcgtaatcaataattcacgaagttgaaaacgtataatcacagttgtccttaaaataaatgtgctgcccaacaaaatactctcggactgacagacagtcgccagtcaagagcccctcgggcagcaggatcttccccctccccaaaaccaaaccagctgcctccgacagcatccaccttttcctcccccaaaccatggacttctccaccggcgggagcgtgagcgggggcggcggaggcgccagcgacggccccgcgcaggcggagcgctggctggagatcgccgagaagctcctcgcggcgcgcgacctcgtcggctgcaagcgcttcgcggagcggtcgatggaggcgaacccgctcctcgctggcgttgacgagctcctcgccgtcgccgacgtcctcctcgcttcccagttcatgggcccctcgggccagccggacccgctcgccatcctccagctgccgcccggagtcagccccgaccaggcc

SEQ ID NO: 24 - DNA, 1191 bp, Zea mays
atggacttctccaccggcgggagcgtgagcgggggcggcggaggcgccagcgacggccccgcgcaggcggagcgctggctggagatcgccgagaagctcctcgcggcgcgcgacctcgtcggctgcaagcgcttcgcggagcggtcgatggaggcgaacccgctcctcgctggcgttgacgagctcctcgccgtcgccgacgtcctcctcgcttcccagttcatgggcccctcgggccagccggacccgctcgccatcctccagctgccgcccggagtcagccccgaccaggccgccgtgtcccgcgccttccgccgcctcgcgctcctcctcggccccagcaacccgcacccgggagccgagatggcgctccgcctcgtcaacgacgcctacgccttcctctcggatccctctcgccgccccccgccgcccgccgatcccgccactggtaccccttactcctcccagtatcccgccgcggccgctcccgcctcggacaccccggagttctggacggcgtgccccttctgctgctacgtgcaccagtacccgcgcagcctgatcgggcgcgccctcaagtgccccaacgcgggctgccgccgcggattcgtggcttctgagctcccgaccccacccaccgttgtgccgggcactgaaatgtaccactgcgcctgggggttcttccccctcggatttcccaacgcggccgacctgggtgccaactggaagccattctacaagatgtttccttggaacacggctcccagtggccaaggtggtggtggtaggagtcacggaaaccatggtggtaggcagccacagaatgacagtgctcgtggtggctcttctagaggtaggatcaagaagacgacggcccgcaagaaggtcggggtagggctcaggagacgttctcttggtgtggagagtggcattgattcttcgatgctcgggcaggaaggctgggctggggatgagaacgctggagatggaagggccgaggaggtgaggagaattaacataaatgaggcagcacatgctacagatggcactggtagggttaatgttagcggtgctggcggagttgaagatatcagcaactttcatatcgatgttgatgcatctgaggatatattggggaatttgcacaacatgcacttcttgagggtggacaatcttggacggatgatttaa

SEQ ID NO: 25 - DNA, 5776 bp, Zea mays
acctagagggggtaaatagatgatcctgcaaaattagctttaaacaacacaaacttggtttgtaaaatatgttagtgagaactaaaaccaagttaggttacgaagagaggagaaaagagaactcttcacttgattgctcctttaaaataagtattaaagttagtagcaatattataaataaatatgagaattaaatagataataatcgcaataagcagaatggtccctctcaggccaaccgttccatccgtatccatttctatcacatcatctctcacgtctgcatgaacatgtgcacatggtatttccttctcaaatttaacccgcgatatgaaaaacatcgttatcaatctttcacatctcaaaataactctacataaattttagtatttgttttatttagttcaatgagaaaaagatttgattatatacattgtagtacacctcacgttctgcttggacacctctatatatcttcctctaggccctatactccctggcccaattaaacaacacggcatcatgcagtaccaaaagacaaaaacaatttctagtagtcgagtgcctcctctctctcctcgataccacataatatgatatatcacatggcagacggtagataaagtaggcggactttgctgggcatagaaaaaaaaaaggatcggcgccaattaccatggcaccgatcttctgtcacgtagacgccagatcagcgtgaaagagtgagatctcgacgccatcttatattggcgcgcgagacatgcaaactcggtactaataataatggcgccggagtaaaggttcattttttgaattgaaacttaaaaagacgtatttgtaataatcttacaaaaaaatatcaaaataaaaaaaaagtcagcgaaacaacgcttcacctattttaaaacgggcctcggcgctcgccctcttggccacagcgcgcctcacagcgacacccacaagaccacgcccccggtcgtgcatcatcatcatcgctcgcgtcttcgagttcgaggacatggagaggccgcgttgctactctccgcttgccctgcacctcctcctctgcctcttctcgctccgcgcctgttccgccgcgtccatcacagccggcacccccgacgagtcggagctgtgggggtacgtcgaggtccggccaagtacgtaacaacccctccctatctcgttgcgcttcagagcctctcctcgtcgaaggcgaggtgtcgccgttgacgacgctttgccgccttgtcgcagaggcgcacctgttctggtggtactacaagagcccgcagaagacgtcgacgccgtccaagccatggcccacggtcctctggctgcagggcggcccggtaggcagctgctgcctcgttctctctttccctcctcacaccaccacaatttctcggcttcggcacaggagggcatgatccggcctctgtgcttcattacgggagcacggtctagctacctgatgagcgagagcgagtgatcaaccatggttgttttgtccctctcgcagggcgcgtccggggtcgggctcggcaacttcctggagatggggccgctggacgtggacctgaagccgcgcaactcgacgtggctccacaaggccgacctcatctttgtggtcagaccagagagcgatagctgatgcctgatggcggctctcttctcctctcttctgccccccgctcttctacacctttcgctgtcgtgatgtcctcgctgaccgacttcttccatggccgggcgcgcgcgcgcaggacaacccggtcggcacagggtacagctacgtggaggacgacagcctgttcgtgaccagcgactggcagcaggccgcggacatgacgacggtggtcagggcgctggcgaaggaggtgcccaccctggcgagcagcccgctgttcctggtcgccgagtcctacggcggcaagtacgccgccacgctcggcgcgtccattgccagggccgtccgcgctggcgagctcaacgtcacgctcggaggttcgtaaggttacttccgttccatctccgggctccgactcgatgaaccaaatcgacgttgggggagcagagcagctgactcgatgaaattctcgttccctcctgctgcaggtgtggcggttggagatagctggatctcgccggaggatttcacggtgaggttgaccattcctagtttcgttagtgcagaaataaaccacggacacattacagagctaatagttacctgctaaaattagctaaatacatttagtctagctaataatttaactattagctattttagtaaactagcgtatagcctgtactaatatattatctagccaaacaataatttatattgtttgtttaccctttaacttatttaagtttgattatataatctagaggatatccaaacctataaaactaatagctagaagctaaaactagctatctcaacctagctaaaaccagctaataagtgattggcgattaaattgctccgaaccatttctacctattagcttattagaaaaagggacgtggatagcttatcagaataatctagggtattagctttagatttagaacatcctcagctaataatagttagccagtaacaattagttgtagaggtttggcttcatctagactaatgctactaaccgagactaaattagaccagtgattttagtcttgttttccatctgatcgggactaaaagatgaagacttgttctgtactagtgttctcttggataaatcacaaatgatgaatacgcatgtgataattaaagtgaggcctgagtgctgctgcagctttcctacacaccgctgcttctgagcgtgtcgaggctggacgacaacgccggcgacgaagcaaacaagtaaggcagcaacaacacgcacactgcaccaccaccatttgcatgcataaatttctcttgacgcttagcgcacccccatcacatatatgggcatgcgaatttgagttcaggaaggcggagacggtgaaggagcaaatcgtggcggggcagtgggccgcctcgcagaagtcatggggcagcctgctagatttcatcgacacaaagagcggcaacgtcgtaagactagtttacttatcttcgttcttatattcaaacttcactcttcgaacaatataatctacagtgcaatctcttttttttggcaggacgtttacaatttcatgctcgactccggcatggacccggtggcactgcccgtgggttcttcatcactgatgagcagcttgcaggcgatgaagtactcgacgtacggccaggactcccagcctggctccaacaccattgacggcatcatgaatggggtcatcaagcaaaagctcaagataatccccaagaacttcacgtatgtcagtccatagcagtgctcatatcgcatcacaagtcacagccggtttcctgctgctaatataatgctgcctgtgacgctggctgcgcttccaaattaaacgtctacaggtggggggagcaatccgactcggtctacaacgcgctggtcaacgatttcatgaaaccgaagatcgatgaggtaaacggatcgagcagatcaatgaaaagcgccctcgatcagtttctgaaatttatccctctttgttttcttattcagattgatgagctgctgtcttatggcattaatgtgacggtgtacaatggccaggtcagtaacagtctgcaacttcttcttacgatccccagcagctcaaaactactcggagctcgtcatcggtttttactgcatgcatgcgttctgttagttcgattagtattacactgcctggcatcctatctgctataaagccgtccactctttgtaattaaaaaaaaaacacagatcatgaaaactagaagacagaccaggataaggtcattggatagtggcttagtgaatgattggcattgactataataatattcgaagttgagattattagcatttactaataagactgcatttttttcattactgaacttgatatatacatgacttttcctctatctgaagctcgacgtaatctgctcgaccaacggagcagaagcatgggttcagaagctcaagtaagtttttttttgcgacctattcccttccctccccttctctggcaggatttcaacgatgcatctggattgctcgttttcagatgggatggtctgaggaccttcctgagcctgccaaggcagcccctctactgtggcgccagcaagggtaccaaggcctttgtcaggtcccacaagaacctgcatttctactggatacttggagcagggcactatgtaagtcccaagtctgaaccccaactgtgccgtctcatctgagatctgcttcccatgtctgtgagagtgtgaggttcttaggtttggatgaaccaaataaaaccttatttgttttctcgtgggatcatctctctgattgcattgcaggtgcctgcagaccagccctgcatcgcgctaagcatgatcagcagcataacccagtcgccagcaagctagttcactgactctatgtggtgtatgccaagaacaaaggaggcgttgaagcaggtagcgcaaggtcccggaggaccattcggcgttcttgaagtgcggtataggttggatacctgaaagacgatgcagttgacaaggacattttttttacagaaaaagatccgataaaaacatatatgatctacgtattacaaaatattgtaaagaggccggaacttgtttttttaataatagaaatgtatctggcttcatcctggtccaaataacgtgccaaataacgtgaaaaatacattgccgcattctctagcttgcggaatgcctgcaacatcggctcctgctcctcagacattgtatttgggcccaagatccaagccaatgcattcgactgaaaatgacatacaagagattttggtcagcaaagttgtcaaattttgacagcttcgtttcttgttagctagatagattaacagatcacagacgtcatgtccataaaaaatggatctttgtagggtattaatcattgaaacagttttggatattcagcggcggagaggtcttcgtcagggagaccctctcttccctatgttgtttgtgctgatcatggacgtgcttagcagtcttttcaggactgctgaatgtaggggattgctgcacagtttggaaagggcaagagtccataacaggctttctatctatgttgatgatgtggtcctttttgttaaacccattgaggaagatctgaaatgtgttagattgattctgaattgttttgggtcggcctccggattggttaccaatatgaataagagttatgctattcctatcagatgtgaggagcatgtggttcaagagggctgcaatatgctgaggtgcagtgtggcctcatttccttgttcttacttgggtctgccaatctcagacaggaagctgaagcgagatgatcttaagttgtggatagataaaattgcagacagactccctaactggaaggctcgtttattgaacctagccgggaggacaacattagtgcggtttgtcttatcggtcatcccaatttatcttcttattgccattaaaattcccaaatgggttattaaatcaattgacaagattcgaagagagtttctttggaaagggtgaaaggaggtgaatggtggaagttgtattgttccctgggaaactgtgacaaggccataagtttagggggtcttggtgttcctaatttgcaattgaagagttgggcactgcaggctaagtggc

SEQ ID NO: 26 - DNA, 1653 bp, Zea mays
gtcttcgagttcgaggacatggagaggccgcgttgctactctccgcttgccctgcacctcctcctctgcctcttctcgctccgcgcctgttccgccgcgtccatcacagccggcacccccgacgagtcggagctgtgggggtacgtcgaggtccggccaaaggcgcacctgttctggtggtactacaagagcccgcagaagacgtcgacgccgtccaagccatggcccacggtcctctggctgcagggcggcccgggcgcgtccggggtcgggctcggcaacttcctggagatggggccgctggacgtggacctgaagccgcgcaactcgacgtggctccacaaggccgacctcatctttgtggacaacccggtcggcacagggtacagctacgtggaggacgacagcctgttcgtgaccagcgactggcagcaggccgcggacatgacgacggtggtcagggcgctggcgaaggaggtgcccaccctggcgagcagcccgctgttcctggtcgccgagtcctacggcggcaagtacgccgccacgctcggcgcgtccattgccagggccgtccgcgctggcgagctcaacgtcacgctcggaggtgtggcggttggagatagctggatctcgccggaggatttcacgctttcctacacaccgctgcttctgagcgtgtcgaggctggacgacaacgccggcgacgaagcaaacaagaaggcggagacggtgaaggagcaaatcgtggcggggcagtgggccgcctcgcagaagtcatggggcagcctgctagatttcatcgacacaaagagcggcaacgtcgacgtttacaatttcatgctcgactccggcatggacccggtggcactgcccgtgggttcttcatcactgatgagcagcttgcaggcgatgaagtactcgacgtacggccaggactcccagcctggctccaacaccattgacggcatcatgaatggggtcatcaagcaaaagctcaagataatccccaagaacttcacgtggggggagcaatccgactcggtctacaacgcgctggtcaacgatttcatgaaaccgaagatcgatgagattgatgagctgctgtcttatggcattaatgtgacggtgtacaatggccagctcgacgtaatctgctcgaccaacggagcagaagcatgggttcagaagctcaaatgggatggtctgaggaccttcctgagcctgccaaggcagcccctctactgtggcgccagcaagggtaccaaggcctttgtcaggtcccacaagaacctgcatttctactggatacttggagcagggcactatgtgcctgcagaccagccctgcatcgcgctaagcatgatcagcagcataacccagtcgccagcaagctagttcactgactctatgtggtgtatgccaagaacaaaggaggcgttgaagcaggtagcgcaaggtcccggaggaccattcggcgttcttgaagtgcggtataggttggatacctgaaagacgatgcagttgacaaggacattttttttacagaaaaagatccgataaaaacatatatgatctacgtattacaaaatattgtaaagaggccggaacttgtttttttaataatagaaatgtatctggcttcatcctggtcca

SEQ ID NO: 27 - DNA, 1800 bp, Zea mays
acgtgggagaccacgcccccggtcgtgcatcatcatcatcgctcgcgtctacgagttcgaggacatggagaggccgcgttgctactctccgcttgccctgcacctcctcctctgcctcttctcgctccgcgcctgttccgccgcgtccatcacagccggcacccccgacgagtcggagctgtgggggtacgtcgaggtccggccaaaggcgcacctgttctggtggtactacaagagcccgcagaagacgtcgacgccgtccaagccatggcccacggtcctctggctgcagggcggcccgggcgcgtccggggtcgggctcggcaacttcctggagatggggccgctggacgtggacctgaagccgcgcaactcgacgtggctccacaaggccgacctcatctttgtggacaacccggtcggcacagggtacagctacgtggaggacgacagcctgttcgtgaccagcgactggcagcaggccgcggacatgacgacggtggtcagggcgctggcgaaggaggtgcccaccctggcgagcagcccgctgttcctggtcgccgagtcctacggcggcaagtacgccgccacgctcggcgcgtccattgccagggccgtccgcgctggcgagctcaacgtcacgctcggaggtgtggcggttggagatagctggatctcgccggaggatttcacgctttcctacacaccgctgcttctgagcgtgtcgaggctggacgacaacgccggcgacgaagcaaacaagaaggcggagacggtgaaggagcaaatcgtggcggggcagtgggccgcctcgcagaagtcatggggcagcctgctagatttcatcgacacaaagagcggcaacgtcgaaggacaaattcaggctgagcagtgggccgcctcgcagaagtcaaacggcaccctgcgaacaatataatcgacacagcaagagcggcaacgtggcaggacgtttacaatttcatgctcgactccggcatggacccggtggcactgcccgtgggttcttcatcactgatgagcagcttgcaggcgatgaagtactcgacgtacggccaggactcccagcctggctccaacaccattgacggcatcatgaatggggtcatcaagcaaaagctcaagataatccccaagaacttcacgtggggggagcaatccgactcggtctacaacgcgctggtcaacgatttcatgaaaccgaagatcgatgagattgatgagctgctgtcttatggcattaatgtgacggtgtacaatggccagctcgacgtaatctgctcgaccaacggagcagaagcatgggttcagaagctcaaatgggatggtctgaggaccttcctgagcctgccaaggcagcccctctactgtggcgccagcaagggtaccaaggcctttgtcaggtcccacaagaacctgcatttctactggatacttggagcagggcactatgtgcctgcagaccagccctgcatcgcgctaagcatgatcagcagcataacccagtcgccagcaagctagttcactgactctatgtggtgtatgccaagaacaaaggaggcgttgaagcaggtagcgcaaggtcccggaggaccattcggcgttcttgaagtgcggtataggttggatacctgaaagacgatgcagttgacaaggacatttttttttacagaaaaagatccgataaaaacatatatgatctacgtattacaaaatattgtaaagaggccggaacttgtttttttaataatagaaatgtatctggcttcatcctggtccaaa

SEQ ID NO: 28 - DNA, 1150 bp, Zea mays
tcacaaatgatgaatacgcatgtgataattaaagtgaggcctgagtgctgctgcagctttcctacacaccgctgcttctgagcgtgtcgaggctggacgacaacgccggcgacgaagcaaacaagaaggcggagacggtgaaggagcaaatcgtggcggggcagtgggccgcctcgcagaagtcatggggcagcctgctagatttcatcgacacaaagagcggcaacgtcgtaagactagtttacttatcttcgttcttatattcaaacttcactcttcgaacaatataatctacagtgcaatctcttttttttggcaggacgtttacaatttcatgctcgactccggcatggacccggtggcactgcccgtgggttcttcatcactgatgagcagcttgcaggcgatgaagtactcgacgtacggccaggactcccagcctggctccaacaccattgacggcaccatgaatggggtcatcaagcaaaagctcaagataatccccaagaacttcacgtggggggagcaatccgactcggtctacaacgcgctggtcaacgatttcatgaaaccgaagatcgatgagattgatgagctgctgtcttatggcattaatgtgacggtgtacaatggccagctcgacgtaatctgctcgaccaacggagcagaagcatgggttcagaagctcaaatgggatggtctgaggaccttcctgagcctgccaaggcagcccctctactgtggcgccagcaagggtaccaaggcctttgtcaggtcccacaagaacctgcatttctactggatacttggagcagggcactatgtgcctgcagaccagccctgcatcgcgctaagcatgatcagcagcataacccagtcgccagcaagctagttcactgactctatgtggtgtatgccaagaacaaaggaggcgttgaagcaggtagcgcaaggtcccggaggaccattcggcgttcttgaagtgcggtataggttggatacctgaaagacgatgcagttgacaaggacattttttttacagaaaaagatccgataaaaacatatatgatctacgtattacaaaatattgtaaagaggccggaacttgtttttttaataatagaaatgtatctggcttcatcctggtcca

SEQ ID NO: 29 - DNA, 4215 bp, Zea mays
aaggacatatttgtaataatctttccaaaaaagtgtcaaaatacaaaaaaaaaagtcagcgaaacaacgcttcacctattttaaaacgggtctcggcgctcgccctcttggccacaggcccacagcgcgcctcacagcgacacccaccacgcccccggtcgtgcatcatcatcatcactcgcgtcttcgagttcgaggacatggacaggccgcgttgctactccccgcttgccctgcacctcctcctctgcctcgtctcgctccgcgcctgttccgccgcgtccatcactgccggcacccccgacgagtcggagctgtgggggtacgtcgaggtccggccaagtacgtaacaccccctccctagctcgttgcgcttcagagcctctcttcgtcgaaggcgaggtgtcgccgttgacgacgctttgccgccttgtcgcagaggcgcacctgttctggtggtactacaagagcccgcagaggacgtcgacgccgtccaagccatggcccacggtcctctggctgcagggcggcccggtaggcagctgctgcctcgttctctctttccctcctcacaccaccacaatttctcggcttcggcacaggaggacatgatccggcctctgtgcttcattacgggagcacggtctagctacctgatgagcaagagcgagtaatcaaccatggttgtcttgtccctctcgcagggcgcgtccggggtcgggctcggcaacttcctggagatggggccgctggacgtggacctgaagccgcgcaactcgacgtggctccacaaggccgacctcatctttgtggtcagaccagagagcgatagctgatggcggctctcttctccgatcctctcttctgccccccgctcttcttctacacctttcgctgtcgtgatgtcctcactgaccgacttcttccatggccgggcgcgcgcgcaggacaacccggtcggcacagggtacagctacgtggaggacgacagcctgttcgtgaccagcgactggcagcaggccgcggacatgacgacggtggtcagggcgctggcgaaggaggtgcccaccctggcgagcagcccgctgttcctggtcgccgagtcctacggcggcaagtacgccgccacgctcggcgcgtccatcgccagggccgtccgcgctggcgagctcaacgtcacgctcggaggttcgtaaggttgcttccgttccatctccgggctccgactcgatgaaccaaatcgacgttgggggagcagagcagagcagagcagctgactcgatgaaattctcgttccctcctgctgcaggtgtggcggttggagatagctggatctcgccggaggatttcacggtgaggttgaccgttcttagtttcgttagtgcagaaataaactgcggctacgttgcagagctaatagttagctgataaaattagctaaaaacatttaaatagtctagctaataatttaactattagctattttagtaaactagcgtgtagcatgtactaatatattatctaaaagccaaataataatctatattgtttgtttaccctttaacttatttaagtttaattatataatctagaggatatccaaacttataaaattaatagctagaagctaaaactagctatcccaacctagctaaaaccagctaataagtgattgacgattaaattgcttcgaaccatttctacctattagcttattagaaaaagggacgtggatagcttatcagaataatctagggtattagctttagatttagaacatcctcaactaataatagttccagtaacaattagttctagaggtttggcttgatctagactaatgctactaaccgagactaaattagaccagtgattttagtcttgtttggtagcttcaatcgagactaatgcttccatctgatcgggactaaaagatgaagacttgttctgtactagtgttctcttggataaatcacaaatgatgaatatgcatgtgataattaaagtgaggcctgaatgctgctgcagctttcctacacaccgctgcttctgagcgtgtcgaggctggacgacaacgccggcgacgaagcaaacaagtaagggggtgtttggtttctagggactaatgtttagtcccttcattttattcctttttagtgtataaattgataaacatagaaattaaaataaagttttagtttctatatttggtaattttggaccaaaaatggaataaaatctagggactaaacattagtccctagaaaccaaacaccctctaaggcagcaacaacacgcacactgcaccaccaccatttgcatgcataaatttctcttgacgcttagcgcacccccatcacatatatgggcatgcgaatttgagttcaggaaggcggagacggtgaaggagcaaatcgtggcggggcagtgggccgcctcgcagaagtcatggagcagcctgctagatttcatcgacacaaagagcggcaacgtcgtaaggctagtttacttatcttcattcttatatttaaacttcactcttcgaacaatataatctacagtgcaatctcttttttttggcaggacgtttacaatttcatgctcgactccggcatggacccggtggcactgctgcccgtgggttcttcatcactgatgagcagcttgcaggcgatgaagaagtactcgacgtacggccaggactcccagcctggctccaacaccattgacggcatcatgaatggggtcatcaagcaaaagctcaagataatccccaagaacttcacgtatgtcagtccatagcagtgctcatatcgcatcacaagtcacagccggtttcctgctgctaatgtaatgctgcctgtgacgctggctgcgcttccaaattaaacgtctacaggtgggggcagcaatccgactcggtctacaacgcgctggtcaacgatttcatgaaaccgaggatcgatgaggtaaactggtcgagcagataaatgaaaagcgccctcgatcagtttctgaaattaatccctcttcattttctcattcagattgatgagctgctgtcttatggcattaatgtgacggtgtacaatggccaggtcagtaacagtctgcaacttcaattcttacgatccccagcagctcaaaactactcggaaaaaaatttgctgcagcccggctgcaaaacagtatgtttacagcccctcacaaaaaggaggatagatctctactcttttttttctcgaatatacaggagacctgcatatctgttagttcgattagtattacactgccatcctatctgctataaagccgtccactctttgtaattaaaaaaaacacagatcatgaaaactagaagacagaccaggataaggtcattggatagtggcttagtgaatgattggcattgactaataatattcgaagttgagattgagattattagcatttactaataagactgcatttttttcattactgaacttgatatatacatgacttttcctctatctgaagctcgacgtaatctgctcgaccaacggagcagaagcatgggttcagaagctcaagtaagttttttttttggcaacctattccctcccattctctggcaggatttcaacgatgcatctggattgctcgttttcagatgggatggtctgaggaccttcctgagcctgccaaggcagcccctctactgtggcgccagcaagggcaccaaggcctttgtcaggtcccacaagaacctgcatttctactggattcttggagcagggcactatgtaagtcccaagtctgaaccctaactgtgccgtctcatctgagatctgcttcccatgtctgtgagagtgggaggttcttaggtttggatgaaccaaaaccttatttgttttctcgtgggatcatctctctgattgcattgcaggtgcctgcagaccagccctgcatcgcgctaagcatgatcagcagcataacccagtcgccagcaagctagttgactgactctatgtggtgtatgccaaaaacaaaggaggcgttgaagcaggtagcgcaaggtcccggaggaccattcggcgttcttgaagtgcggtataggttggatacctgaaaaaatacataagattatattataaaaaggaagaatatacactaaatggtagtataattaattataaaatgtttgtagtccttttcttgcgaagaaaatctttt

SEQ ID NO: 30 - DNA, 5108 bp, Zea mays
tataatccgactacatttaatacccggaacggaggttcaaacattcgatgggacagggactaaattttagcggggtgtaaccaaacacccccttagtagcaatattacaagtgaatatgagaacttaagaagacaataatcgcaataagaagaatggtccctctccggccaaccgttccatccatatccatttctatcacatcatctctcacgtctccatgaacatgtgcacatggtatttccttctcaaatttttacccgcgatatgaaaaacatcgttatcaatctttcacatctcaaaataactctactataaatttttagtatttgttatatttagttcaatgagaaaaggatttgattatatacattgtagtacacgtcatgttctgcttggacacctctgtatatctccctctaggctctatactccctgccccaattaaacaacacggcatcatgccaaaaacaatttctagtagtcgagtgcctactctctctcctcgttctctctccccagtggcatcgaaggaaaagtatatatgattgtacccatgatgtgatataccatatgacagacggtagataaagcaggcggactttgatgggcatagaaaacagggtcggcgccaattaccatggcgccgatctcatgtcacatagacgccacatcagcgtgagagagtgagatctcgacagtcgacgccatctatattgccgcgcgagacgtgcaaactcggtactaataataatggcgccgggtaaaggtctatttttttaattgaaacttaaaaggacatatttgtaataatctttccaaaaaagtgtcaaaatacaaaaaaaaaagtcagcgaaacaacgcttcacctattttaaaacgggtctcggcgctcgccctcttggccacaggcccacagcgcgcctcacagcgacacccaccacgcccccggtcgtgcatcatcatcatcactcgcgtcttcgagttcgaggacatggacaggccgcgttgctactccccgcttgccctgcacctcctcctctgcctcgtctcgctccgcgcctgttccgccgcgtccatcactgccggcacccccgacgagtcggagctgtgggggtacgtcgaggtccggccaagtacgtaacaccccctccctagctcgttgcgcttcagagcctctcttcgtcgaaggcgaggtgtcgccgttgacgacgctttgccgccttgtcgcagaggcgcacctgttctggtggtactacaagagcccgcagaggacgtcgacgccgtccaagccatggcccacggtcctctggctgcagggcggcccggtaggcagctgctgcctcgttctctctttccctcctcacaccaccacaatttctcggcttcggcacaggaggacatgatccggcctctgtgcttcattacgggagcacggtctagctacctgatgagcaagagcgagtaatcaaccatggttgtcttgtccctctcgcagggcgcgtccggggtcgggctcggcaacttcctggagatggggccgctggacgtggacctgaagccgcgcaactcgacgtggctccacaaggccgacctcatctttgtggtcagaccagagagcgatagctgatggcggctctcttctccgatcctctcttctgccccccgctcttcttctacacctttcgctgtcgtgatgtcctcactgaccgacttcttccatggccgggcgcgcgcgcaggacaacccggtcggcacagggtacagctacgtggaggacgacagcctgttcgtgaccagcgactggcagcaggccgcggacatgacgacggtggtcagggcgctggcgaaggaggtgcccaccctggcgagcagcccgctgttcctggtcgccgagtcctacggcggcaagtacgccgccacgctcggcgcgtccatcgccagggccgtccgcgctggcgagctcaacgtcacgctcggaggttcgtaaggttgcttccgttccatctccgggctccgactcgatgaaccaaatcgacgttgggggagcagagcagagcagagcagctgactcgatgaaattctcgttccctcctgctgcaggtgtggcggttggagatagctggatctcgccggaggatttcacggtgaggttgaccgttcttagtttcgttagtgcagaaataaactgcggctacgttgcagagctaatagttagctgataaaattagctaaaaacatttaaatagtctagctaataatttaactattagctattttagtaaactagcgtgtagcatgtactaatatattatctaaaagccaaataataatctatattgtttgtttaccctttaacttatttaagtttaattatataatctagaggatatccaaacttataaaattaatagctagaagctaaaactagctatcccaacctagctaaaaccagctaataagtgattgacgattaaattgcttcgaaccatttctacctattagcttattagaaaaagggacgtggatagcttatcagaataatctagggtattagctttagatttagaacatcctcaactaataatagttccagtaacaattagttctagaggtttggcttgatctagactaatgctactaaccgagactaaattagaccagtgattttagtcttgtttggtagcttcaatcgagactaatgcttccatctgatcgggactaaaagatgaagacttgttctgtactagtgttctcttggataaatcacaaatgatgaatatgcatgtgataattaaagtgaggcctgaatgctgctgcagctttcctacacaccgctgcttctgagcgtgtcgaggctggacgacaacgccggcgacgaagcaaacaagtaagggggtgtttggtttctagggactaatgtttagtcccttcattttattcctttttagtgtataaattgataaacatagaaattaaaataaagttttagtttctatatttggtaattttggaccaaaaatggaataaaatctagggactaaacattagtccctagaaaccaaacaccctctaaggcagcaacaacacgcacactgcaccaccaccatttgcatgcataaatttctcttgacgcttagcgcacccccatcacatatatgggcatgcgaatttgagttcaggaaggcggagacggtgaaggagcaaatcgtggcggggcagtgggccgcctcgcagaagtcatggagcagcctgctagatttcatcgacacaaagagcggcaacgtcgtaaggctagtttacttatcttcattcttatatttaaacttcactcttcgaacaatataatctacagtgcaatctcttttttttggcaggacgtttacaatttcatgctcgactccggcatggacccggtggcactgctgcccgtgggttcttcatcactgatgagcagcttgcaggcgatgaagaagtactcgacgtacggccaggactcccagcctggctccaacaccattgacggcatcatgaatggggtcatcaagcaaaagctcaagataatccccaagaacttcacgtatgtcagtccatagcagtgctcatatcgcatcacaagtcacagccggtttcctgctgctaatgtaatgctgcctgtgacgctggctgcgcttccaaattaaacgtctacaggtgggggcagcaatccgactcggtctacaacgcgctggtcaacgatttcatgaaaccgaggatcgatgaggtaaactggtcgagcagataaatgaaaagcgccctcgatcagtttctgaaattaatccctcttcattttctcattcagattgatgagctgctgtcttatggcattaatgtgacggtgtacaatggccaggtcagtaacagtctgcaacttcaattcttacgatccccagcagctcaaaactactcggaaaaaaatttgctgcagcccggctgcaaaacagtatgtttacagcccctcacaaaaaggaggatagatctctactcttttttttctcgaatatacaggagacctgcatatctgttagttcgattagtattacactgccatcctatctgctataaagccgtccactctttgtaattaaaaaaaacacagatcatgaaaactagaagacagaccaggataaggtcattggatagtggcttagtgaatgattggcattgactaataatattcgaagttgagattgagattattagcatttactaataagactgcatttttttcattactgaacttgatatatacatgacttttcctctatctgaagctcgacgtaatctgctcgaccaacggagcagaagcatgggttcagaagctcaagtaagttttttttttggcaacctattccctcccattctctggcaggatttcaacgatgcatctggattgctcgttttcagatgggatggtctgaggaccttcctgagcctgccaaggcagcccctctactgtggcgccagcaagggcaccaaggcctttgtcaggtcccacaagaacctgcatttctactggattcttggagcagggcactatgtaagtcccaagtctgaaccctaactgtgccgtctcatctgagatctgcttcccatgtctgtgagagtgggaggttcttaggtttggatgaaccaaaaccttatttgttttctcgtgggatcatctctctgattgcattgcaggtgcctgcagaccagccctgcatcgcgctaagcatgatcagcagcataacccagtcgccagcaagctagttgactgactctatgtggtgtatgccaaaaacaaaggaggcgttgaagcaggtagcgcaaggtcccggaggaccattcggcgttcttgaagtgcggtataggttggatacctgaaaaaatacataagattatattataaaaaggaagaatatacactaaatggtagtataattaattataaaatgtttgtagtccttttcttgcgaagaaaatcttttaaatggcatttgtgtgaagcacaatgtttagagtcctaaaaatgcaattgtctctgttggggacttgctctcaaatgctatgaatcaagagcaagacaaca

SEQ ID NO: 31 - DNA, 1659 bp, Zea mays
gtcttcgagttcgaggacatggacaggccgcgttgctactctccgcttgccctgcacctcctcctctgcctcttctcgctccgcgcctgttccgccgcgtccatcacagccggcacccccgacgagtcggagctgtgggggtacgtcgaggtccggccaaaggcgcacctgttctggtggtactacaagagcccgcagaagacgtcgacgccgtccaagccatggcccacggtcctctggctgcagggcggcccgggcgcgtccggggtcgggctcggcaacttcctggagatggggccgctggacgtggacctgaagccgcgcaactcgacgtggctccacaaggccgacctcatctttgtggacaacccggtcggcacagggtacagctacgtggaggacgacagcctgttcgtgaccagcgactggcagcaggccgcggacatgacgacggtggtcagggcgctggcgaaggaggtgcccaccctggcgagcagcccgctgttcctggtcgccgagtcctacggcggcaagtacgccgccacgctcggcgcgtccattgccagggccgtccgcgctggcgagctcaacgtcacgctcggaggtgtggcggttggagatagctggatctcgccggaggatttcacgctttcctacacaccgctgcttctgagcgtgtcgaggctggacgacaacgccggcgacgaagcaaacaagaaggcggagacggtgaaggagcaaatcgtggcggggcagtgggccgcctcgcagaagtcatggggcagcctgctagatttcatcgacacaaagagcggcaacgtcgacgtttacaatttcatgctcgactccggcatggacccggtggcactgctgcccgtgggttcttcatcactgatgagcagcttgcaggcgatgaagaagtactcgacgtacggccaggactcccagcctggctccaacaccattgacggcatcatgaatggggtcatcaagcaaaagctcaagataatccccaagaacttcacgtggggggagcaatccgactcggtctacaacgcgctggtcaacgatttcatgaaaccgaagatcgatgagattgatgagctgctgtcttatggcattaatgtgacggtgtacaatggccagctcgacgtaatctgctcgaccaacggagcagaagcatgggttcagaagctcaaatgggatggtctgaggaccttcctgagcctgccaaggcagcccctctactgtggcgccagcaagggtaccaaggcctttgtcaggtcccacaagaacctgcatttctactggatacttggagcagggcactatgtgcctgcagaccagccctgcatcgcgctaagcatgatcagcagcataacccagtcgccagcaagctagttcactgactctatgtggtgtatgccaagaacaaaggaggcgttgaagcaggtagcgcaaggtcccggaggaccattcggcgttcttgaagtgcggtataggttggatacctgaaagacgatgcagttgacaaggacattttttttacagaaaaagatccgataaaaacatatatgatctacgtattacaaaatattgtaaagaggccggaacttgtttttttaataatagaaatgtatctggcttcatcctggtcca

SEQ ID NO: 32 - DNA, 1795 bp, Zea mays
agttcatcactaatcacacttattgtgccctcgacgagtatctatagctagctcattaatcgattcgggggtgtgttgtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctggaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatgcagaactgcccgcgcatctttcctcagaagtgagtccgatgctgccgccattgttcttgcatccatccagcatcgtacgtacgtcctctatacatctgcggatcatcatgtgcgcatgtttgtggcatgcatgcatgcatgtgagcaggagcaggcttgcggccgccatgtccgcgctgaggaagccaaagtacaacggcaagtgcatgcgcagcctgattaggagcatcctcggcgagacgagggtaagcgagacgctgaccaacgtcatcatccctgccttcgacatcaggctgctgcagcctatcatcttctctacctacgacgtacgtacgtcgtcacgaatgattcatctgtacgtcgtcgcatgcgaatggctgcctacgtacgccgtgcgctaacatactcagctctttcctatctgctgcgccaatttgcaggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccggtaactgactagctaactggaaaacggacgcacagactccatgtccatggcggcccacaaggtcgatgctaattgttgcttatgtatgtcgcccgattgcacatgcgtagacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatat

SEQ ID NO: 33 - DNA, 1452 bp, Zea mays
agttcatcactaatcacacttattgtgccctcgacgagtatctatagctagctcattaatcgattcgggggtgtgttgtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctggaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatgcagaactgcccgcgcatctttcctcagaagagcaggcttgcggccgccatgtccgcgctgaggaagccaaagtacaacggcaagtgcatgcgcagcctgattaggagcatcctcggcgagacgagggtaagcgagacgctgaccaacgtcatcatccctgccttcgacatcaggctgctgcagcctatcatcttctctacctacgacgccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatat

SEQ ID NO: 34 - DNA, 4564 bp, Zea mays
aaggaaaggtcacacatcctagctagcttcactggttctagctccttccaattttgcaaaaaagtcacaaaggataagccatttttccaaatgatttgtgaaatgcctatgctaaaaagcctacttttccgaaaaaccagagctagagccatttttgacaagtcagaaccctaccaaatagtccctcagtttaagcaaagtgaggccatactgaagctaaattatgccaaattgggcctacatctccatattttcaaccaaatgctttagggtttcttgtaatcgacatgatttgtttcttcataaatagtatatggaccgctccaaaatactccatccgtttcaatttatatttcgtttgatctttttaccctaaatttgatcgactcgtcttattaaaaaaagttcataactattaataatctttactgtgatatcatttagcatataatatactttaattgtggctttgatttttttccgcaaaaattaaatgaaacgacccaatcaaacttgataaaaaagtaaaactaattataaatttggacagaaggagtaggagggtgtttgaatacactagagttaatagttagttgccttaaaatttgctagtacaattagctagctaacaaatatttaggtaactattagctaatttgctaaaaacagctaatagttaaactattagctagactgtttggatgtattcagctaattttagcagctaactattagctatagtataatattcaaacacctcctaattaaaatggacaaatatctcttcccttggtcccttgcgttagatttccatatctccttatttagtataaaaagaatcatcaaaaagtggacaacccctagtggaacaccattttagtagtggttgcatgaaacctttcgcgcatcagttactatgtgtcactctaaaaatggggcagcatgtacgcagtgcctatatttatacaaggcatctatcgttgcctcctcagttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagtgagtccgatgctgccgccattgttcttgcatccatgcatccagcatcgtacgtcctctatacatctgcggatgatcatttgcgcatgtttgtggcatgcatgcatgtgatgtgagcaggagcaggcttgcggccgccatgtccgcgctgaggaagccaaagtacaacggcaagtgcatgcgcagcctgattaggagcatcctcggcgagacgagggtaagcgagacgctgaccaacgtcatcatccctgccttcgacatcaggctgctgcagcctatcatcttctctacctacgacgtacgtacgtcgtcacgaatgattcatctgtacgtcgtcgcatgcgaatggctgcctacgtacgccgtgcgctaacatactcagctctttcctatctgctgcgccaatttgcaggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccggtaactgactagctaactggaaaacggacgcacagactccatgtccatggcggcccacaaggtcgatgctaattgttgcttatgtatgtcgcccgattgcacatgcgtagacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggagaacaaggctcgcgcgccgcgtgtctgccatcaacccaagaggctctagatgtgcgtcgtacgatatctaagacaagtggctttactgtcagtcacatgcttgtaaataagtagactttattttaataaaacataaaaatatatatatgttcttgaatataaaattgataaccaaaattcgaaccatcacttatacataattttactttattttttataaaacgtgaacgggaaggactaccatgaatgactatagaaccaatcatactagtataaaatatatgatgacactacgagagagacaaactttgtctggcgctaaatattttgccgagtgtgaattcacgggcactaggcaaagatcttctttgccgagtgttacgctgggcaaagtaagacactaggtaaatcagtcatttgccgagtgtccgccactaggcaaagcaaaacactggcaaatcaaaagtttacctagtgccagacactaggcaaaaaaaaacgctcggcaaatcggaagtttccctagtgccagacactagacaaagaaaaacacttgataaactagcgtcgtcagctaacaccatccaccaaccgttaacgttgccgagtatctgacttcgacactcggcaaagaaggtctctttgcctagtgtcggtctggaacactaggcaaagaggcactttacctagtgtcgtattttgacactcagtaaaataattttttttctttctgcttccaaactttttatgatgtgttcctatagcacctagaactacatgtcaagttttggtaaaatttttgaagtttttgctatatttacttaatttattttatttaattgaatttcttttgataattcaaatttgaactcggcaaggtaagaagcgagggtagcctggaaacacactttgcctagtgttacactcggtacaggagcctcccctgcctagtgctgcactcgacaaaagattcgcctttgcctagcgctgcactcggcacaggagtcgcctttgcctagtgctgcactaggcaaagcctccgttaccgtgccttccatcgtcatggaaacttttcttcgccgagtgacgtgtggcactaggcaaagtttttgccgagtgcccgagaaatggcactcggcaaggactctttgtcgatcccttcgttgccgacttctttttgccgagtgcaacactaggcaaaccatttgccgagtgtaaaagaggctttgcctagtgtctgtggcactaggcaaagaagacgagtcctgtagtgaacctagtaggccagtgcgggaccattccaaaaaatacctataaaaataaatttaatattaaattaaacatatggtccacgtaccaagatattaaactcaaaagaacaattattacaatttatcttagctaaaaggccgagaaaagtatatgttaaaaaggagtgtgatcccatttttatagctcgctcggtcgatcgcccgtccacttttaggtaacgaggtggtaccatgtaggagtgttgcgttgcgtgcgacttcctatcatgttgggcttaggtggcttctcacgacccaatgataggcgagaagtgtggaagatgaacaaacctacttgtttcgtgcacgacgcatgtgtttgaacaacgagttagattagaaaaaaaatataatgactttttttttgcaaaagtgaggataatgaaaaccagaaaaactggtgcttcataagagtagagatttgatggtaaatatagtagtaatgcaatggctatactacacgcgagagtccaatggcaagccggtgtgttggggcgaaggcgaagacgctacccttcgctccaggcctttgtcaactcgctgcaccaacagaggcaagatgaccggcgcggcccacccttcgtcctcttcactgcaagacgaaggcctacgac

SEQ ID NO: 35 - DNA, 2089 bp, Zea mays
caccggcggtctcatcaccgccatgctcaccgcgcccggcaaggacaagcggcctctctacgctgccaaggacatcaactacttttacatggagaactgcccgcgcatcttccctcagaagtgagtccgatgctgccgccattgttctcgcatccatccagcatcgtacgtcctctatacatctgcggatgatcatttgcgcatgtttgtggcatgcatgtgagcaggagcaggcttgcggccgccatgtccgcgctgaggaagccaaagtacaacggcaagtgcatgcgcagcctgattaggagcatcctcggcgagacgagggtaagcgagacgctgaccaacgtcatcatccctgccttcgacatcaggctgctgcagcctatcatcttctctacctacgacgtacgtacgtcgtcacgaatgattcatctgtacgtcgtcgcatgcgaatggctgcctacgccgtgcgctaacatactcagctctttccgatctgctgcgccaatttgcaggccaagagcacgcctctgaagaacgcgctgctctcggacgtgtgcattggcacgtccgccgcgccgacctacctcccggcgcactacttccagactgaagacgccaacggcaaggagcgcgaatacaacctcatcgacggcggtgtggcggccaacaacccggtaactgactagctaactgcaaaacgaacgcacagactccatgtccatggcggcccacaaggtcgatgctaattgttgcttatgtatgtcgcccgattgcacatgcgtagacgatggttgcgatgacgcagatcaccaaaaagatgcttgccagcaaggacaaggccgaggagctgtacccagtgaacccgtcgaactgccgcaggttcctggtgctgtccatcgggacggggtcgacgtccgagcagggcctctacacggcgcggcagtgctcccggtggggcatctgccggtggctccgcaacaacggcatggcccccatcatcgacatcttcatggcggccagctcggacctggtggacatccacgtcgccgcgatgttccagtcgctccacagcgacggcgactacctacgcatccaggacaactcgctccgtggcgccgcggcaaccgtggacgcggcgacgccggagaacatgcggacgctcgtcgggatcggggagcggatgctggcacagcgggtgtccagggtcaacgtggagacagggagcgaggtacgaaccggtgaccggagaaggaagcaatgccgatgccctcggtgggctcgctaggcagctctccgaggagaggagaacaaggctcgcgcgccgcgtctctgccatcaaccccagaagctctagatgtgcgccctacgatatctaagacaagtggctttactgtcaatcacatgcttgtaaataagtagactttattttaataaaatataaatatatatatattctgataaccaagattcgaaccctcacttatacacaattttatcttattttttataaaatgagaatggaaaggactaccgtgaacgactatagaaccaatcatactagtttaaaatgctcgtaagctatgacgaacctagtaggccggtgctggaccattccaaaaaacctataaaaataaatttaatattaaattaaacatatggtctatatatcagatattaaactcaaaagaataattattataatttatcttagctaaaaggttgagaaaggtatgcgttaaaaaagagttttaacccatttttatagcttatttgatcgcccgtccacttttagggagcgaggtggtactatgcagaagtgttgcgctgtgtgcgacttactatcatgttgggtttaggtggattctcacgacccaatgatagacgagaagtgtgggagatgaacaaacctacgcatttcgcgtacgacacatgtgtttgaacaacgagttagattggaaaaaatataatgaccttttttgcaaaaatgactacaatgaaaaccaggaaaaccggtgcttcataggagtagagatttgacggtaaattgttacgatctactggtatttgctgcgaggatgtattcgct

SEQ ID NO: 36 - DNA, 3557 bp, Zea mays
tgacgtttggtaaaacgacttcttccgaaaaacacccaaaaacccaagatattttatactacgaaggaaaggtcacacatcctagttagcttcactggttctagctccttccaattttgcaaaaaagtcacaaaggataagccattttttcaaatgatttgtgaaatgcctacgctaaaaagtctacttttccaaaaaaactagagctagagccgtttttggcaagtcagaaccctaccaaatagtccctcagtttaagcaaagtgaggctatactgaagctaaattatgccaaattgggcctacatctccatattttcaaccaaatgctttagggtttcttgtaatcgacatgatttgtttcttcataaatagtatatggaccgctccaaaatactccatccgtttcaatttatattacgtttgatctttttaccctaaatttgatcgactcgtcttattaaaaaagttcataactattaataatctttactgtgatatcatttagcatataatatactttaagtgtagctttgattttttttttgcaaaaattaaatgaaacgacccaatcaaacttgataaaaaagtaaaactaattataaatttggacataaggagtaggagggtgtttgaatacactagagttaatagttagttgtcttaaaatttgctagtacaattagctagctaacaaatatttaggtaactattagctaatttgctaaaaacagctaatagttgaactattagttgaactattagctagactgtttggatgtattcaactaattttagcagctaactattagttatagtataatattcaaacacctcctaattaaaatggacaaatatctattcccttggtcccttgcgttagattttccatatatcctcatttagtataaaaagaatcatcaaaaagtggacaacccctagtggaacaccattttagtagtggttgcatgaaacctttcgcgcatcagttactatgtgtcactctaaaaatggggcagcatgtacgcagtgcctatatttatacaaggcatctatcgttgcctcctcagttcatcactaatcacacttattgtgccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctggaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaactacttttacatggagaactgcccgcgcatcttccctcagaagtgagtccgatgctgccgccattgttctcgcatccatccagcatcgtacgtcctctatacatctgcggatgatcatttgcgcatgtttgtggcatgcatgtgagcaggagcaggcttgcggccgccatgtccgcgctgaggaagccaaagtacaacggcaagtgcatgcgcagcctgattaggagcatcctcggcgagacgagggtaagcgagacgctgaccaacgtcatcatccctgccttcgacatcaggctgctgcagcctatcatcttctctacctacgacgtacgtacgtcgtcacgaatgattcatctgtacgtcgtcgcatgcgaatggctgcctacgccgtgcgctaacatactcagctctttccgatctgctgcgccaatttgcaggccaagagcacgcctctgaagaacgcgctgctctcggacgtgtgcattggcacgtccgccgcgccgacctacctcccggcgcactacttccagactgaagacgccaacggcaaggagcgcgaatacaacctcatcgacggcggtgtggcggccaacaacccggtaactgactagctaactgcaaaacgaacgcacagactccatgtccatggcggcccacaaggtcgatgctaattgttgcttatgtatgtcgcccgattgcacatgcgtagacgatggttgcgatgacgcagatcaccaaaaagatgcttgccagcaaggacaaggccgaggagctgtacccagtgaacccgtcgaactgccgcaggttcctggtgctgtccatcgggacggggtcgacgtccgagcagggcctctacacggcgcggcagtgctcccggtggggcatctgccggtggctccgcaacaacggcatggcccccatcatcgacatcttcatggcggccagctcggacctggtggacatccacgtcgccgcgatgttccagtcgctccacagcgacggcgactacctacgcatccaggacaactcgctccgtggcgccgcggcaaccgtggacgcggcgacgccggagaacatgcggacgctcgtcgggatcggggagcggatgctggcacagcgggtgtccagggtcaacgtggagacagggagcgaggtacgaaccggtgaccggagaaggaagcaatgccgatgccctcggtgggctcgctaggcagctctccgaggagaggagaacaaggctcgcgcgccgcgtctctgccatcaaccccagaagctctagatgtgcgccctacgatatctaagacaagtggctttactgtcaatcacatgcttgtaaataagtagactttattttaataaaatataaatatatatatattctgataaccaagattcgaaccctcacttatacacaattttatcttattttttataaaatgagaatggaaaggactaccgtgaacgactatagaaccaatcatactagtttaaaatgctcgtaagctatgacgaacctagtaggccggtgctggaccattccaaaaaacctataaaaataaatttaatattaaattaaacatatggtctatatatcagatattaaactcaaaagaataattattataatttatcttagctaaaaggttgagaaaggtatgcgttaaaaaagagttttaacccatttttatagcttatttgatcgcccgtccacttttagggagcgaggtggtactatgcagaagtgttgcgctgtgtgcgacttactatcatgttgggtttaggtggattctcacgacccaatgatagacgagaagtgtgggagatgaacaaacctacgcatttcgcgtacgacacatgtgtttgaacaacgagttagattggaaaaaatataatgaccttttttgcaaaaatgactacaatgaaaaccaggaaaaccggtgcttcataggagtagagatttgacggtaaattgttacgatctactggtatttgctgcgaggatgtattcgcttggtgaaaacagaattacagagtagcagtagcagggaagacagtagcgagaggagaagaagaaacttgagga

SEQ ID NO: 37 - DNA, 1382 bp, Zea mays
agttcatcactaatcacacttattgtgccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctggaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaactacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgcgctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaacccgtcgaactgccgcaggttcctggtgctgtccatcgggacggggtcgacgtccgagcagggcctctacacggcgcggcagtgctcccggtggggcatctgccggtggctccgcaacaacggcatggcccccatcatcgacatcttcatggcggccagctcggacctggtggacatccacgtcgccgcgatgttccagtcgctccacagcgacggcgactacctacgcatccaggacaactcgctccgtggcgccgcggcaaccgtggacgcggcgacgccggagaacatgcggacgctcgtcgggatcggggagcggatgctggcacagcgggtgtccagggtcaacgtggagacagggagcgaggtacgaaccggtgaccggagaaggaagcaatgccgatgccctcggtgggctcgctaggcagctctccgaggagaggagaacaaggctcgcgcgccgcgtctctgccatcaaccccagaagctctagatgtgcgccctacgatatctaagacaagtggctttactgtcaatcacatgcttgtaaataagtagactttattttaataaaatataaatatatatatattctga

SEQ ID NO: 38 - DNA, 10843 bp, Zea mays
cgcacacactgtctttctctgcctttctttccctagcgccgcgccggcgccgccattcgatcaggccgcttcgccggcgacagcatattccaggtatgccgtcccttctgctccttctgcgagaattcaaacaccccgaactccccaaatctagtatttgtattcggatctgaccatttttcactgggcccgcccctgattcgcaggtcggttggttttggcacttcggaccggcggccatggcttccgacggcatcggccccagaggtataactgtttcatctcttctttgtgttcaaacagacagacgtcaaaccgccgagaggaggtacaaatatagattttgggctatgagcacgccattgcgcttccagcgatctgacatattgggaattcttgttttttttttgggtaccttgcaaggccgaaatttgacgcttttctgtttaattctagtgcctgtctgcatccattagggcatcctagctgctccatgctcgtgatctcgtccgtttgcttgattgaatccattgttttccaaagttcattgctactgcgaaatacgtttatatgattaccacaatttgtgtttttgccttttcgggttgcacagagggtactgccatcattgttgttttagcgccatttggaacaagtgattcactggtactagtacagtatgtgcttttcatgtgtgtttggtttgtaccatcagatggaattttgagcgcggtttacaaattagtactatagatatactgtgaggtgcacactagatggttctgctttgttctacagtcagtaactttttcttccttgctcacagatgtatgtgttgttggggttgcacgcaccccaatgggcggtttccttggtgccttgtctcccttgcctgctacgaaacttggctctatagtaattcaaggtgagatccgaatcttctctgcatttacatccgagctctgaacatggtcatggctgggggctgttagctgctctggaaagagcaaacgtggatccagccctcgtgcaggaggtctactttggaaacgtcttgagtgctaatttggggcaagctcctgcaaggcaagctgctctgggtgccgggataccaaactctgttgtttgcaccactgttaacaaagtctgtgcatctggcatgaaaggtttgaatcgaatttatctgtctgtccttgtgtactctgctcagagttcacagaagtgagagattacctgaccatgctcttgttttcctttcctatatgcagctactatgtttgcagcacagtcaattcaattgggtatcaatgatattgttgtggctggtggcatggaaagcatgtccaatgccccaaagtacattgctgaagctaggtatgcaattattacttggtggatatattcaatatcgagctgcataaaccaaatgatagtcttaagttatttggtagatacatgcatgcttacttatcttcattgcattttctaaatttgtttgtaagaaatgttgattcaccagcagcgaggctattaacgaagtggccagttttgttgtgaaagtatattctgttcatgtttaaagtgcatttcaactgcttataagcttgctaattacaattgcaggaaggggtctcgttttggtcatgacacacttgttgatgccatgcttaaggatgggctttgggatgtatacaatgattgtgccatgggaatgtgtgccgagctttgtgctgacaaccatgccctcacaagagaagaccaggtctcttaatacagatagcagtaaatgctgtttgttataatattcccatatttttcaagatataagttgtgctatacaacatgtcaatgctggcaattcttttgagactgccctggaatcttcgtgctttatcttggtcatcatcataaatggtctagagactctagaccagcatctgcattccttgtctgatgaactagtaacttggatcctttctagcaatgattttctgttatgttgtgacatgattgatagggtgggcttttatgcatgctctgggtctgtgaactgaccattcatctgcttccagagatgaaagtagatgtgccacacaaaaatgagcactcttttgtattcctgttagagctatacaagtataatctcttaaaagctgctcatcagtacatgacactagtaccttgatgattttactgtatctgtttatgtaatttttttcttaataaatttgatatagtataattaaaattgagttgccttttaattttcacttatatgttgcaatttatttttgtctatattgcaataaatatatttccaatttctggtatatttaattttacttattcttgaataggatgcatttgctatccaaagcaacgagcgtggaattgctgctcgtgacagtggtgcttttgcatgggagattattccggtaattttctccctcattgatgatactagacatgcttttcttggttttctgatggtcagtgttgtcacccaggttcaagttcctgttggtagaggaaaacccccaacattaattgagagagatgaaagcctggataaggtattttttctgacgtgacaaaatatttttaacaaaataaagcttgtagttgatcaaaggcaaaaagactggcaggcactttgatttattgttcttgcttcctccaaatgcaacgttccttgcataatgagctttgctagcagttatttgtaagatcaatgcatgacagttttatttatgtcttgtgctattccttttgtgtcttagtttgacccagtaaaactaaagaaacttcgcccaagtttcaaggagaatggtggtacagttacagctggaaatgcttctagtataaggtagctgcttgaaatatttctgaggccttttgtcctacaaagtctttctgagaccttgtttttcggccatatgttgtttagctgacagatatgaaggacaacctatttcattgttgacagttaaattatattattgtattatgcatgcatttttaactgatatattatgcttgcattttgtcaacttcattgtttctctatttgtttttagactgcttgggtatgctctactccgttaaatagatggtaattttttctttagatttggtacccaattggtgtgaatgatttatcacaatatcacataagaaagtaaaaacattttaaatgccttattatgcccattcaaacaacaaaagttgccctaccttttaaatttcttcatggttgccctagaccttgtttgtctcactttgtactgtgtctatttttagctgacaagtactgtccggtgtactgcctactatggcttgtgtagccttctgcaaccagtcatctaatttgttttatatggatcagtgatggagctgctgcattagttttagtgagtgggcagaaggctcaagagcttggccttcaagtccttgcaaggatcaaaggttatgctgatgcagctcaagtaagccacagaaacaattgttagctctcctaagagtagaatgcgcttattctaatttacactgtgatctaaatattttaggatataggaagttatttttatctggaacgattttatgttactattttagatatcgaaatttatcaactattggaacttgtgatctggaatattattttgtaatgtggatgctgtttatacaggctccggagctttttacaaccactccagcacttgcaataccaaaggctatcgcaaatgctggattagagtcatcccgtgttgatttctatgagattaatgaagccttttcggtatgcattgagtttcttttactcacattttttgtaagccttttgttatgcattgagagtttattttacttattactttttttgtaataatgtcttttttacttgtcaatataggctgttgcgcttgcaaatcaaaaacttcttggaattccttcagtaagtgtcacctgtattaaactgccattctttgtggattttagaagttaaacaatcactttcagaaagtacatattgtctcttttttgttatttgctatgcagcagcaacgtgtaattgcattataacagtattatctgtactaacagcatatgtgtttgcaggaaaagattaatgttcatggaggagctgtatccttaggacatcctctcgggtgcagtggtgctcgcattttggttacccttattggtgtaagttctatcttaagatgcttgttttaccttttgagttacaatcccttttgtttaaaaaaaatgtgcaatgtttttctagtaaaaaaatagatggtctttgagtaaataatgaattctgacatatgttaccatatcatcatagggttcgtgatgaacagtaagcatcttcactattgctactaggtctacttcctctatcccaaattataagacgtcttgggatgttggcattgttagatttatagcttttactacgtgtactgagacataatgtttatcgcaataaaaactacaaatctagaaaaagtaaaaacatcttataatttgaaacatagggagtatgttggatcaagccaccccatccctgcaccaaacactaccttaggccatgttcggttacaagtggttcgagggggattgaaggggattaaatccccttctagttaaaattgaataggaggggatttaatccccctcaatcccctccaatcctctcgcaaccgaacaagcccttagtgatttccaatgtgcaaattatctgcaaatagaatcttgtataaagctgcaaatgtagagtttcacattgatatcggctcatcccttgtttcacttgttgctggtgatcaatagtttctttttctcttcattttctttaagcaaaacgttgggcacaatatagtgccatcatgttgggacatcaaaatatattgtgcttgaccctcctaatcattgtttcttgttaacaggttctcagggcgaagagtggcaagatcggagttgctggtgtctgcaacggtggaggcggagcatcagctcttgttctggagctcgcataagaaatctagaccttgtaagactcaaaacaccgaatatatctcaactcaaattgattcttttactagctggcagtaggagctaaccagtataaggtgctattatcaaactgtaatatggtcgcatattcagctaggcctaattaagttgtattttttccttttacaactgttgtgcaatttgactaactgctgcaccttgatattgcaggtagttagcaaaagctccctgaggtgatcttgtagtcttattttccgttgtagtagtcccatagaacatttcttaatttaatttggcaataaagcaaaagctccctgaggagatattgcttctgttggttgcatagtagagtatcatgtaataagagctacagaaatatttttgatatatttgtgaggatactacagaaatattttatatatttgtgatgtgtcttgtacatttatctaggtcacatcaactatcctgccgcccgggatctggaactccgacagcccgatttcaaatagtttgaaagaacatcagcaaacacccaaggcaaatacaaagatcagagaagctggagggttagttacaggagcatcaggttaccgagaatgcaaccatgcacggcaaaaggcgcctaccccgcatcaaaatttctgccagaaacaaacaagaaacgaaagaatcacacgcacactatctacatccagaaacgtgatgttatactagatagtcagcggcattcaggaagccctcgtactgggtaccgttgagggcgctgtagacctcgtcccagttctcgatctgctccgacagcggcttcgtgtgtatcttcacgtgccggctcaccagcttcctcctcggcactccgaggaaatccaggacatccaagagcttctgcagtgcagcagcgatggtaagcgacacaaccaacggaagggaacagacaagggaagggcatcagcgagaacgcactgttctgttgcggacgacgtcctcgtagtagacgctcatgtgccgggtgttgtttaggttctcaagagcgtcgcgagtgtactcgtcagctcgtttcagctgccatatcagtgacgtcgtgttgagcctgggcctgtatcttgccagtatatgggcctgtggagcgagaacgaacgacacgtcaaacacagagagagatcagatcagctcagagacttgctgccatatccgtttcttagctagcattactaacctcacgcttcgtgtggacatgggccttgtgcgttccgtttagttgcttaagtaacctgtcgtggttgttcgctacctgtgataccaactggcggagcaggttccttctgaaaagaaatatcgcagagactcctcttcggttgaagtagtcgactacgtccgcatggtttgccacgaggccctgaaaacatacaccccaaccccgttcagaagaaatgctcctttgtttccactctctagctacaatgcctgttttgtttccagtctctaaacctatgtttggccaatattcatggtttggttaggcaatctgtctaccaggaaaaaagttcgttctcgcacaaattagatgaagccctgaaacaaacatgcttgacatgtagattataatcagtctactggacacactacagaatctatcaaatattactccatatgcatttgcagttctcatgcatgttcgagagagagaaaatttgtctaaaatgcaggatctgacagcaagtcagaaaactaaactagctaccgacagttccataaggccttgttcggttattcgcatcccacatggattggaagagattggaaaattttaagaaggattttgacttcttatggatttaaactcatccaatctcgtccaatccacatggattggcactaaaacgagcaagccctaaagtggattcccaaaaaaaaatagttacatggacttgaggaaagtttggcgcaatatgcaataacatttagcatctacagttgagaacatgtaggccgtttaggagactacacatactaataattgaaacatactggaactaaatggaaaaataaatgaaaaaggatcatccaaataaattatctatactgcatgttttagtccgcacctgatttagcatccacttgaagccaatagctgcagtgcactcattcttggaagcgctactgttccagtccaaattgtacactttatccagggtatctattatagaggaaatgttactcctcctttcttttctagagaaaatttcaccattggagctaacattcatgtggctgttaagaagtgtttcaaaccagccacttccagatcgctgcgatgatataattgcaaaggaccggacagcattgcacttgcattcctccctagaaataaaaaattatgcattaggcattaaacaaacgagattgctcaatcttaccacagtgcagatctcacctgctgtaaatataggaagttatttttatctggaacgattttatgttactattttagatatcgaaatttatcaactattggaacttgtgatctggaatattattttgtaatgtggatgctgtttatacaggctccggagctttttacaaccactccagcacttgcaataccaaaggctatcgcaaatgctggattagagtcatcccgtgttgatttctatgagattaatgaagccttttcggtatgcattgagtttcttttactcacattttttgtaagccttttgttatgcattgagagtttattttacttattactttttttgtaataatgtcttttttacttgtcaatataggctgttgcgcttgcaaatcaaaaacttcttggaattccttcagtaagtgtcacctgtattaaactgccattctttgtggattttagaagttaaacaatcactttcagaaagtacatattgtctcttttttgttatttgctatgcagcagcaacgtgtaattgcattataacagtattatctgtactaacagcatatgtgtttgcaggaaaagattaatgttcatggaggagctgtatccttaggacatcctctcgggtgcagtggtgctcgcattttggttacccttattggtgtaagttctatcttaagatgcttgttttaccttttgagttacaatcccttttgtttaaaaaaaatgtgcaatgtttttctagtaaaaaaatagatggtctttgagtaaataatgaattctgacatatgttaccatatcatcatagggttcgtgatgaacagtaagcatcttcactattgctactaggtctacttcctctatcccaaattataagacgtcttgggatgttggcattgttagatttatagcttttactacgtgtactgagacataatgtttatcgcaataaaaactacaaatctagaaaaagtaaaaacatcttataatttgaaacatagggagtatgttggatcaagccaccccatccctgcaccaaacactaccttaggccatgttcggttacaagtggttcgagggggattgaaggggattaaatccccttctagttaaaattgaataggaggggatttaatccccctcaatcccctccaatcctctcgcaaccgaacaagcccttagtgatttccaatgtgcaaattatctgcaaatagaatcttgtataaagctgcaaatgtagagtttcacattgatatcggctcatcccttgtttcacttgttgctggtgatcaatagtttctttttctcttcattttctttaagcaaaacgttgggcacaatatagtgccatcatgttgggacatcaaaatatattgtgcttgaccctcctaatcattgtttcttgttaacaggttctcagggcgaagagtggcaagatcggagttgctggtgtctgcaacggtggaggcggagcatcagctcttgttctggagctcgcataagaaatctagaccttgtaagactcaaaacaccgaatatatctcaactcaaattgattcttttactagctggcagtaggagctaaccagtataaggtgctattatcaaactgtaatatggtcgcatattcagctaggcctaattaagttgtattttttccttttacaactgttgtgcaatttgactaactgctgcaccttgatattgcaggtagttagcaaaagctccctgaggtgatcttgtagtcttattttccgttgtagtagtcccatagaacatttcttaatttaatttggcaataaagcaaaagctccctgaggagatattgcttctgttggttgcatagtagagtatcatgtaataagagctacagaaatatttttgatatatttgtgaggatactacagaaatattttatatatttgtgatgtgtcttgtacatttatctaggtcacatcaactatcctgccgcccgggatctggaactccgacagcccgatttcaaatagtttgaaagaacatcagcaaacacccaaggcaaatacaaagatcagagaacgrmmgtgagcatcaggttaccgagaatgcaaccatgcacggcaaaaggcgcctaccccgcatcaaaatttctgccagaaacaaacaagaaacgaaagaatcacacgcacactatctacatccagaaacgtgatgttatactagatagtcagcggcattcaggaagccctcgtactgggtaccgttgagggcgctgtagacctcgtcccagttctcgatctgctccgacagcggcttcgtgtgtatcttcacgtgccggctcaccagcttcctcctcggcactccgaggaaatccaggacatccaagagcttctgcagtgcagcagcgatggtaagcgacacaaccaacggaagggaacagacaagggaagggcatcagcgagaacgcactgttctgttgcggacgacgtcctcgtagtagacgctcatgtgccgggtgttgtttaggttctcaagagcgtcgcgagtgtactcgtcagctcgtttcagctgccatatcagtgacgtcgtgttgagcctgggcctgtatcttgccagtatatgggcctgtggagcgagaacgaacgacacgtcaaacacagagagagatcagatcagctcagagacttgctgccatatccgtttcttagctagcattactaacctcacgcttcgtgtggacatgggccttgtgcgttccgtttagttgcttaagtaacctgtcgtggttgttcgctacctgtgataccaactggcggagcaggttccttctgaaaagaaatatcgcagagactcctcttcggttgaagtagtcgactacgtccgcatggtttgccacgaggccctgaaaacatacaccccaaccccgttcagaagaaatgctcctttgtttccactctctagctacaatgcctgttttgtttccagtctctaaacctatgtttggccaatattcatggtttggttaggcaatctgtctaccaggaaaaaagttcgttctcgcacaaattagatgaagccctgaaacaaacatgcttgacatgtagattataatcagtctactggacacactacagaatctatcaaatattactccatatgcatttgcagttctcatgcatgttcgagagagagaaaatttgtctaaaatgcaggatctgacagcaagtcagaaaactaaactagctaccgacagttccataaggccttgttcggttattcgcatcccacatggattggaagagattggaaaattttaagaaggattttgacttcttatggatttaaactcatccaatctcgtccaatccacatggattggcactaaaacgagcaagccctaaagtg

SEQ ID NO: 39 - DNA, 1704 bp, Zea mays
gtgttgcgttccctacttgctcttttcttcctccgcttcaacctgtcccgagcgccccccgcgcacacactgtctttctctgcctttctttccctagcgccgcgccggcgccgccattcgatcaggccgcttcgccggcgacagcatattccaggtcggttggttttggcacttcggaccggcggccatggcttccgacggcatcggccccagagatgtatgtgttgttggggttgcacgcaccccaatgggcggtttccttggtgccttgtctcccttgcctgctacgaaacttggctctatagtaattcaaggtgagatccgaatcttctctgcatttacatccgagctctgaacatggtcatggctgggggctgttagctgctctggaaagagcaaacgtggatccagccctcgtgcaggaggtctactttggaaacgtcttgagtgctaatttggggcaagctcctgcaaggcaagctgctctgggtgccgggataccaaactctgttgtttgcaccactgttaacaaagtctgtgcatctggcatgaaagctactatgtttgcagcacagtcaattcaattgggtatcaatgatattgttgtggctggtggcatggaaagcatgtccaatgccccaaagtacattgctgaagctaggaaggggtctcgttttggtcatgacacacttgttgatgccatgcttaaggatgggctttgggatgtatacaatgattgtgccatgggaatgtgtgccgagctttgtgctgacaaccatgccctcacaagagaagaccaggatgcatttgctatccaaagcaacgagcgtggaattgctgctcgtgacagtggtgcttttgcatgggagattattccggttcaagttcctgttggtagaggaaaacccccaacattaattgagagagatgaaagcctggataagtttgacccagtaaaactaaagaaacttcgcccaagtttcaaggagaatggtggtacagttacagctggaaatgcttctagtataagtgatggagctgctgcattagttttagtgagtgggcagaaggctcaagagcttggccttcaagtccttgcaaggatcaaaggttatgctgatgcagctcaagctccggagctttttacaaccactccagcacttgcaataccaaaggctatcgcaaatgctggattagagtcatcccgtgttgatttctatgagattaatgaagccttttcggctgttgcgcttgcaaatcaaaaacttcttggaattccttcagaaaagattaatgttcatggaggagctgtatccttaggacatcctctcgggtgcagtggtgctcgcattttggttacccttattggtgttctcagggcgaagagtggcaagatcggagttgctggtgtctgcaacggtggaggcggagcatcagctcttgttctggagctcgcataagaaatctagaccttgtagttagcaaaagctccctgaggtgatcttgtagtcttattttccgttgtagtagtcccatagaacatttcttaatttaatttggcaataaagcaaaagctccctgaggagatattgcttctgttggttgcatagtagagtatcatgtaataagagctacagaaatatttttgatatatttgtgaggatactacagaaatattttatatatttgtgatgtgtcttgtac

SEQ ID NO: 40 - DNA, 1637 bp, Zea mays
gtgttgcgttccctacttgctcttttcttcctccgcttcaacctgtccccagcgccccccgcgcacacactgtctttctctgcctttctttccctagcgccgcgccggcgccgccattcgatcaggccgcttcgccggcgacagcatattccaggtcggttggttttggcacttcggaccggcggccatggcttccgacggcatcggccccagagatgtatgtgttgttggggttgcacgcaccccaatgggcggtttccttggtgccttgtctcccttgcctgctacgaaacttggctctatagtaattcaagctgctctggaaagagcaaacgtggatccagccctcgtgcaggaggtctactttggaaacgtcttgagtgctaatttggggcaagctcctgcaaggcaagctgctctgggtgccgggataccaaactctgttgtttgcaccactgttaacaaagtctgtgcatctggcatgaaagctactatgtttgcagcacagtcaattcaattgggtatcaatgatattgttgtggctggtggcatggaaagcatgtccaatgccccaaagtacattgctgaagctaggaaggggtctcgttttggtcatgacacacttgttgatgccatgcttaaggatgggctttgggatgtatacaatgattgtgccatgggaatgtgtgccgagctttgtgctgacaaccatgccctcacaagagaagaccaggatgcatttgctatccaaagcaacgagcgtggaattgctgctcgtgacagtggtgcttttgcatgggagattattccggttcaagttcctgttggtagaggaaaacccccaacattaattgagagagatgaaagcctggataagtttgacccagtaaaactaaagaaacttcgcccaagtttcaaggagaatggtggtacagttacagctggaaatgcttctagtataagtgatggagctgctgcattagttttagtgagtgggcagaaggctcaagagcttggccttcaagtccttgcaaggatcaaaggttatgctgatgcagctcaagctccggagctttttacaaccactccagcacttgcaataccaaaggctatcgcaaatgctggattagagtcatcccgtgttgatttctatgagattaatgaagccttttcggctgttgcgcttgcaaatcaaaaacttcttggaattccttcagaaaagattaatgttcatggaggagctgtatccttaggacatcctctcgggtgcagtggtgctcgcattttggttacccttattggtgttctcagggcgaagagtggcaagatcggagttgctggtgtctgcaacggtggaggcggagcatcagctcttgttctggagctcgcataagaaatctagaccttgtagttagcaaaagctccctgaggtgatcttgtagtcttattttccgttgtagtagtcccatagaacatttcttaatttaatttggcaataaagcaaaagctccctgaggagatattgcttctgttggttgcatagtagagtatcatgtaataagagctacagaaatatttttgatatatttgtgaggatactacagaaatattttatatatttgtgatgtgtcttgtac

SEQ ID NO: 41 - DNA, 1780 bp, Zea mays
cagagcaccagctcaccgccccaccgattcaaaggcgctcggatcctctgacgtcgacgttccctgccagctcccggctgccgccctcgctccttccgccatctgcgctgctctgcggcgccagagccggcgcccgcccgctgccgccctcgacggaccgggacacggggccccaccgttctctttcctgcgctgcgctgcgcggcggctgtgctgctgatcagttaatgtgcctgtgaggctgtgacaggcggcgtcgagcgagtccgaggcgggctaactaaacccgccgtctctcgaggcggcgcccgcggagggccaggtggagggccgaggaaggtggaggcggtgaggcgatggggggcgccaaggcggaggacaagcccgccgccgccaccgctgaagacgattggtgttaccagtttggaaacaagaatgcgtttgactcgaaggccccgaaaaaatcaccacttgcattgagagtggttgtctttgccatgactgtgttatgtgggatatctatttggtcaatgtgtatgaagcagctagggagtgatggctggtcaagaatagtgaagatcgaagttgtggaacaaccatgtaataagtctacagttcctccttctgaggttcaatttgcgcattaccctcaaccgacaacttacagcagggaggaatgcaagtgcaatgctgtccggttctttgcgattatatcatcacagcgatctggaagtggctggtttgaaacccttcttaacagccacatgaatgttagctccaacggtgaaattttctctagaaaagaaaggagaagtaacatttcctctataatagataccctggataaagtgtacaatttggactggaacagtagcgcttccaagaatgagtgcactgcagctattggcttcaagtggatgctaaatcagggcctcgtggcaaaccatgcggacgtagtcgactacttcaaccgaagaggagtctctgcgatatttcttttcagaaggaacctgctccgccagttggtatcacaggtagcgaacaaccacgacaggttacttaagcaactaaacggaacgcacaaggcccatgtccacacgaagcgtgaggcccatatactggcaagatacaggcccaggctcaacacgacgtcactgatatggcagctgaaacgagctgacgagtacactcgcgacgctcttgagaacctaaacaacacccggcacatgagcgtctactacgaggacgtcgtccgcaacagaacaaagctcttggatgtcctggatttcctcggagtgccgaggaggaagctggtgagccggcacgtgaagatacacacgaagccgctgtcggagcagatcgagaactgggacgaggtctacagcgccctcaacggtacccagtacgagggcttcctgaatgccgctgactatctagtataacatcacgtttctggatgtagatagtgtgcgtgtgattctttcgtttcttgtttgtttctggcagaaattttgatgcggggtaggcgccttttgccgtgcatggttgcattctcggtaacctgatgctcctgtaactaaccctccagcttctctgatctttgtatttgccttgggtgtttgctgatgttctttcaaactatttgaaatcgggctgtcggagttccagatcccgggcggcaggatagttgatgtgacctagataaatgtacaagacacatcacaaatatataaaatatttctgtagtatcctcaaaaaaaaaaaaaaaaaaaaaaaaaag

SEQ ID NO: 42 - DNA, 11900 bp, Zea mays
aacgccatggagaaatcacacatgagacaccaattactcaaggagtttacttaattatattttacttaaattgagtataggattcatcgtactaccaaggggatccaaaaataaggttggtgtttgccaaagctcaagcctctatattcaaaagctattttttgaaaatcaaaaatctctttaaaattctatggttgactatggttaggtttgagaaacctagagtgtttttgttgaaaagcagctgagcttttcagctgaactaaacttcagctgagttgagcttcttcagctgcagttgagcttttcagctgagctaaacttcagctgtgtcgagctttctcaactccagttgaacttcaacttcaactggggtccagtcaagttcaaccggggtccaggcaggttcaaccggggtccaaggcaagttcaaccggggtccagagaggttcaactggggtccaggaaaagttcaaccggggtttagagaggttcaaccagggatgggctgtacgcaacgcgtctaagaattgtacgtgtgttctctcgtaaccagaagcagcctcacctcctttgtatatataaacgagcagagggaggcgaacggatagtaacggtcaccatcagagctatcattacagccagccagaaacggacgccattagtgacgtccgttaatagctgacaagcattataactcgttcgttactatccataacataggaaacgaccaataacgtacaacagtaatggacggtcatcactttaggcaaaatgtgcaaccgttaggaaggaatattcggaccaaggtccgatctaccacggccacggcccggcggcgcgcgcgtgtggcagtccttcatcattttctcaacttctcactagatgcaccaaagatccgcctatttaagttgattgaattgtcccttgtacttccggtatggtactaaagtactagtacaccgtagcattaaagtgggcctttagcattgactattattgaatattaatttgggttaggccctcattaattcaacagtagcttctaggcctaaccatcccaccccccaaactaagcatagatgaactatgtttaggttgctacaaaaatattccaaaaaataattccctccgtcctaaaatactaaccgttttagcattttaatagattcataaaaatatgtcagatccacaagtcatacgaggcaactgtctcgagcatgatggatggagaaccaatatcccccttgtaaaatgtcttcttcctccacttccaatgcatgcaatctatactcaatatcataatagaaaatcccctttccacctccttagctaagataagcctaagtcattgacaatggcatgataattgtactccgccctgaaacatgcaataccacctctacagaatagaccaaaaactccactcgtaggggaaatactgcccccacggtaagaagaagcttaatcggagccctgatcgagaaaggtcacgaaagatgtacccctccccccatgcaacatgagagtccgccccctataggccagatctttactcgtgctttgagccctactagcccttacacgaggatccgccccataggtcagcccatctcatgtgcacacaactagggaaactagtgagtgaccttgttaacctcagcctaaaattcgctcccaccgggattcaaacttaggacctgaggagtgctactcagacgacctaaccaacttaactagggaccctttcacacagaatagtccaaggcactctgaggtggaactttcctcattttgatgtactcatcgatggagtcagcaatgctacagtacgcaagcatgcttaggccaattgtgcacttctggtgggggaggaaacactgcggttgaatgcatcggttcaaaaagtgaagtatgggaagtgctcacccaatctctctaagatatgaaggaagagacttctctagatgcggtaactttgacaaaagtagagcagtgggtagacacacaggtcgttgaaatggtcttgcattaaccggtcgtatgcaactacatagtcgcagtcaatgtatctctgatgttgccttggccacctcatcgacctaggagactcggatccaagctctgacgcctgttgcattatattttgttgtaataacttgaataactcttttcagtcatattgatgtccaagctgaacgaaaacatcacaacaatgcttgatttgattgaaacgagtgtaagaggattataaggggtggtagagaaatttgaagtgtgggttgtgtgaatgagatcaaacactcctctatttatagaccaagttctagtttttttatttttgaaaaaaaatcaaaataaagcgaagcaattagaacctgccacatggcaagaggcgatcgttatcgacatggccgcaatagctgttcagtaccaaccagtcagtatcgaccgacgcggtcccaacacggtcaatagtaaccctggcggccgatcagtagcctcgacaaccacaagcgaggctattagtgctggcaccatgtcgggtgatactgaccatttggttgtgccacatgggtgggcgggcagtagagccaagcgccggcactcgcctaacatgatctaaaacaatcgataaaactgacagattggttgcggttcatgactacctagacctggtcgaccacaagtagaaaatgagtcgagccgagcttgactcggctcgtccatttcacgagctagagagttaggctcggctcagctcgaagtcggctcgcgagctacaccccgatatatattatttcattatatagtaaattattaatatataaacataaaatataaaaatattattcaccattatgaattatcttatatttatcatcaaaggctaagaaataagccgactatctataaattatctaatatctatcattattctacatattgattaatttggtacaactagctcgctcgcagacgctccgaacttgatctgactcgtgagcctcaagttttttttctagccttaaccacatgcccgcgaggatgattgttcgaggtgattagcaaacgcaaacgatatcaattgacattttttattagtttcattaggtttagagataaaattatatcatgtatgtcactcgtctagtatcttatttgttatcataaatgttctaatcctttttacgtcacccgaatacaattttttactctttcatgtcatagtaagggactaagacatacaacattttacatttaacatttggccacgacatgtaagagtgagatattgaattcgagtaacatacgaggtacgatgaataaggtattacacaaaattacagtggcatatagtgaattgaattgttctatttttactttttttttgcctaacataaagcctattttatttagtactttctctgattcagctttaatttttatgatttattaattttattatatatctatatattgtatagattaaaaaataaaataaattatagatttaggaaaaattacattcgggtgatttggctgttgggtgttgcgttccctacttgctcttttcttcctccgcttcaacctgtccccagcgccccccgcgcacacactgtctttctctgcctttctttccctagcgccgcgccggcgccgccattcgatcaggccgcttcgccggcgacagcatattccaggtatgccgtcccttctgctccttctgcgagaattcaaacaccccgaactccccaaatctagtatttgtattcggatctgaccatttttcactgggcccgcccctgattcgcaggtcggttggttttggcacttcggaccggcggccatggcttccgacggcatcggccccagaggtataactgtttcatctcttctttgtgttcaaacagacagacgtcaaaccgccgagaggaggtacaaatatagattttgggctatgagcacgccattgcgcttccagcgatctgacatattgggaattcttgttttttttttgggtaccttgcaaggccgaaatttgacgcttttctgtttaattctagtgcctgtctgcatccattagggcatcctagctgctccatgctcgtgatctcgtccgtttgcttgattgaatccattgttttccaaagttcattgctactgcgaaatacgtttatatgattaccacaatttgtgtttttgccttttcgggttgcacagagggtactgccatcattgttgttttagcgccatttggaacaagtgattcactggtactagtacagtatgtgcttttcatgtgtgtttggtttgtaccatcagatggaattttgagcgcggtttacaaattagtactatagatatactgtgaggtgcacactagatggttctgctttgttctacagtcagtaactttttcttccttgctcacagatgtatgtgttgttggggttgcacgcaccccaatgggcggtttccttggtgccttgtctcccttgcctgctacgaaacttggctctatagtaattcaaggtgagatccgaatcttctctgcatttacatccgagctctgaacatggtcatggctgggggctgttagctgctctggaaagagcaaacgtggatccagccctcgtgcaggaggtctactttggaaacgtcttgagtgctaatttggggcaagctcctgcaaggcaagctgctctgggtgccgggataccaaactctgttgtttgcaccactgttaacaaagtctgtgcatctggcatgaaaggtttgaatcgaatttatctgtctgtccttgtgtactctgctcagagttcacagaagtgagagattacctgaccatgctcttgttttcctttcctatatgcagctactatgtttgcagcacagtcaattcaattgggtatcaatgatattgttgtggctggtggcatggaaagcatgtccaatgccccaaagtacattgctgaagctaggtatgcaattattacttggtggatatattcaatatcgagctgcataaaccaaatgatagtcttaagttatttggtagatacatgcatgcttacttatcttcattgcattttctaaatttgtttgtaagaaatgttgattcaccagcagcgaggctattaacgaagtggccagttttgttgtgaaagtatattctgttcatgtttaaagtgcatttcaactgcttataagcttgctaattacaattgcaggaaggggtctcgttttggtcatgacacacttgttgatgccatgcttaaggatgggctttgggatgtatacaatgattgtgccatgggaatgtgtgccgagctttgtgctgacaaccatgccctcacaagagaagaccaggtctcttaatacagatagcagtaaatgctgtttgttataatattcccatatttttcaagatataagttgtgctatacaacatgtcaatgctggcaattcttttgagactgccctggaatcttcgtgctttatcttggtcatcatcataaatggtctagagactctagaccagcatctgcattccttgtctgatgaactagtaacttggatcctttctagcaatgattttctgttatgttgtgacatgattgatagggtgggcttttatgcatgctctgggtctgtgaactgaccattcatctgcttccagagatgaaagtagatgtgccacacaaaaatgagcactcttttgtattcctgttagagctatacaagtataatctcttaaaagctgctcatcagtacatgacactagtaccttgatgattttactgtatctgtttatgtaatttttttcttaataaatttgatatagtataattaaaattgagttgccttttaattttcacttatatgttgcaatttatttttgtctatattgcaataaatatatttccaatttctggtatatttaattttacttattcttgaataggatgcatttgctatccaaagcaacgagcgtggaattgctgctcgtgacagtggtgcttttgcatgggagattattccggtaattttctccctcattgatgatactagacatgcttttcttggttttctgatggtcagtgttgtcacccaggttcaagttcctgttggtagaggaaaacccccaacattaattgagagagatgaaagcctggataaggtattttttctgacgtgacaaaatatttttaacaaaataaagcttgtagttgatcaaaggcaaaaagactggcaggcactttgatttattgttcttgcttcctccaaatgcaacgttccttgcataatgagctttgctagcagttatttgtaagatcaatgcatgacagttttatttatgtcttgtgctattccttttgtgtcttagtttgacccagtaaaactaaagaaacttcgcccaagtttcaaggagaatggtggtacagttacagctggaaatgcttctagtataaggtagctgcttgaaatatttctgaggccttttgtcctacaaagtctttctgagaccttgtttttcggccatatgttgtttagctgacagatatgaaggacaacctatttcattgttgacagttaaattatattattgtattatgcatgcatttttaactgatatattatgcttgcattttgtcaacttcattgtttctctatttgtttttagactgcttgggtatgctctactccgttaaatagatggtaattttttctttagatttggtacccaattggtgtgaatgatttatcacaatatcacataagaaagtaaaaacattttaaatgccttattatgcccattcaaacaacaaaagttgccctaccttttaaatttcttcatggttgccctagaccttgtttgtctcactttgtactgtgtctatttttagctgacaagtactgtccggtgtactgcctactatggcttgtgtagccttctgcaaccagtcatctaatttgttttatatggatcagtgatggagctgctgcattagttttagtgagtgggcagaaggctcaagagcttggccttcaagtccttgcaaggatcaaaggttatgctgatgcagctcaagtaagccacagaaacaattgttagctctcctaagagtagaatgcgcttattctaatttacactgtgatctaaatattttaggatataggaagttatttttatctggaacgattttatgttactattttagatatcgaaatttatcaactattggaacttgtgatctggaatattattttgtaatgtggatgctgtttatacaggctccggagctttttacaaccactccagcacttgcaataccaaaggctatcgcaaatgctggattagagtcatcccgtgttgatttctatgagattaatgaagccttttcggtatgcattgagtttcttttactcacattttttgtaagccttttgttatgcattgagagtttattttacttattactttttttgtaataatgtcttttttacttgtcaatataggctgttgcgcttgcaaatcaaaaacttcttggaattccttcagtaagtgtcacctgtattaaactgccattctttgtggattttagaagttaaacaatcactttcagaaagtacatattgtctcttttttgttatttgctatgcagcagcaacgtgtaattgcattataacagtattatctgtactaacagcatatgtgtttgcaggaaaagattaatgttcatggaggagctgtatccttaggacatcctctcgggtgcagtggtgctcgcattttggttacccttattggtgtaagttctatcttaagatgcttgttttaccttttgagttacaatcccttttgtttaaaaaaaatgtgcaatgtttttctagtaaaaaaatagatggtctttgagtaaataatgaattctgacatatgttaccatatcatcatagggttcgtgatgaacagtaagcatcttcactattgctactaggtctacttcctctatcccaaattataagacgtcttgggatgttggcattgttagatttatagcttttactacgtgtactgagacataatgtttatcgcaataaaaactacaaatctagaaaaagtaaaaacatcttataatttgaaacatagggagtatgttggatcaagccaccccatccctgcaccaaacactaccttaggccatgttcggttacaagtggttcgagggggattgaaggggattaaatccccttctagttaaaattgaataggaggggatttaatccccctcaatcccctccaatcctctcgcaaccgaacaagcccttagtgatttccaatgtgcaaattatctgcaaatagaatcttgtataaagctgcaaatgtagagtttcacattgatatcggctcatcccttgtttcacttgttgctggtgatcaatagtttctttttctcttcattttctttaagcaaaacgttgggcacaatatagtgccatcatgttgggacatcaaaatatattgtgcttgaccctcctaatcattgtttcttgttaacaggttctcagggcgaagagtggcaagatcggagttgctggtgtctgcaacggtggaggcggagcatcagctcttgttctggagctcgcataagaaatctagaccttgtaagactcaaaacaccgaatatatctcaactcaaattgattcttttactagctggcagtaggagctaaccagtataaggtgctattatcaaactgtaatatggtcgcatattcagctaggcctaattaagttgtattttttccttttacaactgttgtgcaatttgactaactgctgcaccttgatattgcaggtagttagcaaaagctccctgaggtgatcttgtagtcttattttccgttgtagtagtcccatagaacatttcttaatttaatttggcaataaagcaaaagctccctgaggagatattgcttctgttggttgcatagtagagtatcatgtaataagagctacagaaatatttttgatatatttgtgaggatactacagaaatattttatatatttgtgatgtgtcttgtacatttatctaggtcacatcaactatcctgccgcccgggatctggaactccgacagcccgatttcaaatagtttgaaagaacatcagcaaacacccaaggcaaatacaaagatcagagaagctggagggttagttacaggagcatcaggttaccgagaatgcaaccatgcacggcaaaaggcgcctaccccgcatcaaaatttctgccagaaacaaacaagaaacgaaagaatcacacgcacactatctacatccagaaacgtgatgttatactagatagtcagcggcattcaggaagccctcgtactgggtaccgttgagggcgctgtagacctcgtcccagttctcgatctgctccgacagcggcttcgtgtgtatcttcacgtgccggctcaccagcttcctcctcggcactccgaggaaatccaggacatccaagagcttctgcagtgcagcagcgatggtaagcgacacaaccaacggaagggaacagacaaagggcatcagcgagaacgcactgttctgttgcggacgacatcctcgtagtagacgctcatgtgccgggtgttgtttaggttctcaagagcgtcgcgagtgtactcgtcagctcgtttcagctgccatatcagtgacgtcgtgttgagcctgggcctgtatcttgccagtatatgggcctgtggagcgagaacgaacgacacgtcaaacacagacagagatcagctcagctcagagacttgctgtgagagtgagacattagccgcgaacacgtttcttagctagcattactaacctcacgcttcgtgtggacatgggccttgtgcgttccgtttagttgcttaagtaacctgtcgtgattgttcgctacttgtgataccaactggcggagcaggttccttctgaaaagaaatattgcagagactcctcttcgattgaagtagtcgactacgtccgcatggtttgccacgaggccctgaaaacatacaccccaaccccaaccccgttcagaagaaatgctcctttgtttccactctctagctacagtgcctgttttgtttccagtctctaactctatgtttggccaacattcatggtttggttaggcaatctgtctaccaggaaaaaagtttgttctcacacaaattagatgaagccctgaaacaaacatgcttgacatgtagattataatcagtctactggacacactacagaatctatcaaatattactccatatgcatttgcagttctcatgcacgttcgagagaaaaaaattgtctaaaatgcaggatctgacagcaagtcacaaaactaaactagctatccgacagtcccataaggttattcgcatcccacatagattggaagggattggaaaattttaagaaggattttgacttcttacggatttaaacccgttcaatctcgtccaatccacatggattggcactaagacgagcaagccctaaagtggattcccaaaaaaaaatagttccatggacttgaggaaagtttggagcaatatgcaatactggaactaaatggaaaaataaatgaaaaagggtcatccaaataaatctatactgcatgttttagtccgcacctgatttagcatccacttgaagccaatagctgcagtgcactcattcttggaagcgctactgttccagtccaaattgtacactttatccagggtatctattatagaggaaatgttactcctcctttcttttctagagaaaatttcaccattggagctaacattcatgtggctgttaagaagagtttcaaaccagccacttccagatcgctgcgatgatataattgcaaaggaccggacagcattgcacttgcattcctccctagaaattaaaaattatgtattaggcattaaacaaacgagattgctcaatcttaccacagttgcagatctcacctgctgtaagttatcggttgaggatagcgcacaaattgagcctccgaaagaggagcaatggacttattacatggttgtcccacaacttcaatcttgacaactcttgaccagccatcactccctagttgcttcatgcacattgagcaaatagatatcccgcataacatagtcatagcaaagacaaccgttctcaacgcgatcggtgattttttcgggggcttcaagtcaaatgcatcctgcaaacagatccgaccagtacaaaaccaatcagcaggttgcactgcgcatacgcggttcagtgccagtatatatacattgcagcccttttttgaggtaagatctgttattttgtaaccttctgctacagtaaaaaaacctttcagcaaacaacacaaacattaatgttcaatgtgagctgagaagcatccatttggctacatctatataagcagaaataaaaagaaataaacaaataaaacttcaaggtctatctagtcctcagggaagttaaaatgagcacgtactattcaattcagctactagcctttttaccaacatggaagacacggcaagggatgaaaaggcccttttttgataagttcaagtacattcccatatattctgtcgcccagctgccttagggggcgtttggttgccttctccagtggtgcagctgcatctacacatgcaaaaagtagtgtttgtttggttcgttgtatcgcacgagacaggctagcacggaacttaaagcgccgcgagccaggcccggcagaaacgcatcgcgcgaccgcacgcgcgcggccaggctccgctcagccagctctttactcgtgcacgcatatcgagacacgtttttaattggttttttcattatatc

SEQ ID NO: 43 - DNA, 1411 bp, Zea mays
gtgttgcgttccctacttgctcttttcttcctccgcttcaacctgtccccagcgccccccgcgcacacactgtctttctctgcctttctttccctagcgccgcgccggcgccgccattcgatcaggccgcttcgccggcgacagcatattccaggtcggttggttttggcacttcggaccggcggccatggcttccgacggcatcggccccagaggatgtatgtgttgttggggttgcacgcaccccaatgggcggtttccttggtgccttgtctcccttgcctgctacgaaacttggctctatagtaattcaagctgctctggaaagagcaaacgtggatccagccctcgtgcaggaggtctactttggaaacgtcttgagtgctaatttggggcaagctcctgcaaggcaagctgctctgggtgccgggataccaaactctgttgtttgcaccactgttaacaaagtctgtgcatctggcatgaaagctactatgtttgcagcacagtcaattcaattgggtatcaatgatattgttgtggctggtggcatggaaagcatgtccaatgccccaaagtacattgctgaagctaggaaggggtctcgttttggtcatgacacacttgttgatgccatgcttaaggatgggctttgggatgtatacaatgattgtgccatgggaatgtgtgccgagctttgtgctgacaaccatgccctcacaagagaagaccaggatgcatttgctatccaaagcaacgagcgtggaattgctgctcgtgacagtggtgcttttgcatgggagattattccggttcaagttcctgttggtagaggaaaacccccaacattaattgagagagatgaaagcctggataagtttgacccagtaaaactaaagaaacttcgcccaagtttcaaggagaatggtggtacagttacagctggaaatgcttctagtataagtgatggagctgctgcattagttttagtgagtgggcagaaggctcaagagcttggccttcaagtccttgcaaggatcaaaggttatgctgatgcagctcaagctccggagctttttacaaccactccagcacttgcaataccaaaggctatcgcaaatgctggattagagtcatcccgtgttgatttctatgagattaatgaagccttttcggctgttgcgcttgcaaatcaaaaacttcttggaattccttcagaaaagattaatgttcatggaggagctgtatccttaggacatcctctcgggtgcagtggtgctcgcattttggttacccttattggtgttctcagggcgaagagtggcaagatcggagttgctggtgtctgcaacggtggaggcggagcatcagctcttgttctggagctcgcataagaaatctagaccttgta

SEQ ID NO: 44 - DNA, 5790 bp, Zea mays
gggggcagtctatactgcccccttaatagttagtagagatttggtacaactcacgagctagctcgctcgcagacgctccgaacttgatctgactcgtgagcctcaagttttttttctagccttaaccacatgcccacgaggatgattgttcgaggtgattagcaaacgcaaacgatatcaattgacattttttattagtttcattaggtttagagataaaattatatcatgtatgtcactcatctagtatcttatttgttatcataaatgttctaatcctttttacgtcacccgaatacaattttttactctttcatgtcatcgttgatgacatagtaagggactaagacatacaacattttacatttaacatttggccacgacatgtaagagtgagatattgaattcgagtaacatacgaggtacgatgaataaggtattacacaaaattacagtggcatatagtgaattgaattgttctatttttactttttttttgcctaacataaagcctattttatttagtactttctctgattcagctttaatttttatgatttattaattttattatatatctatatattgtatagattaaaaaataaaatagattatagatttaggaaaaattacattcgggtgatttggctgttgggtgttgcgttccctacttgctcttttcttcctccgcttcaacctgtccccagcgccccccgcgcacacactgtctttctctgcctttctttccctagcgccgcgccggcgacgccattcgatcaggccgcttcgccggcgacagcatattccaggtatgccgtcccttctgctccttctgcgagaattcaaacaccccgaactccccaaatctagtatttgtattcggatctgaccatttttcactgggcccgcccctgattcgcaggtcggttggttttggcacttcggaccggcggccatggcttccgacggcatcggccccagaggtattactgtttcatctcttcttgtgttcaaacagacagacgtcaagccgccgagaggaggtacaaatatagattttgggtaatgagcacgccattgcgcttccagcgatctgacatattgggaattcttgcttttttttgggtaccttgcaaggccgaaatttgacgcttttctgtttaattctagtgcctgtctgcatccattagggcatcctagctgctccatgctcgtgatctcgtccgtttgcttgattgaatccattgttttccaaagttcattgctactgcgaaatacgtttatatgattaccacaagttgtgttttttccttttcgggttgcacagagggtactgccatcattgttgttatagcgccatttggaacaagtgattcactggtactagtacagtatgtgcttttcatgtgtgtttggtttgtaccatcagatggaattttgagcgcggtttacaaattagtactatagatatactgtgaggtgcacactagatggttctgctttgttctacagtcagtaactttttcttccttgctcacagatgtatgtgttgttggggttgcacgcaccccaatgggcggtttccttggtgccttgtctcccttgcctgctacgaaacttggctctatagtaattcaaggtgagatccgaatcttctctgcatttacatccgagctctgaacatggtcatggctgggggctgttagctgctctggaaagagcaaacgtggatccagccctcgtgcaggaggtctactttggaaacgtcttgagtgctaatttggggcaagcgcctgcaaggcaagctgctctgggtgccgggataccaaactctgttgtttgcaccactgttaacaaagtctgtgcatctggcatgaaaggtttgaatcgaatttatctgtctgtccttgtgtactctgctcagagttcacagaagtgagagattacctgaccatgctcttgtttccctttcctatatgcagctactatgtttgcagcacagtcaattcaattgggtatcaatgatattgttgtggctggtggcatggaaagcatgtccaatgccccaaagtacattgctgaagctaggtatgcaattattacttggtggatatattcaatatcgagctgcataaaccaaatgatagtcttaagttatttggtagatacatgcatgcttacttatcttcattgcattttctaaatttgtttgtaagaaatgttgattcaccagcagcgaggctattaacgaagtggccagttttgttgtgaaagtatattctgttcatgtttaaagtgcatttcaactgctttaatccaataagcttgctacttacaattgcaggaaggggtctcgttttggtcatgacacacttgttgatgccatgcttaaggatgggctttgggatgtatacaatgattgtgccatgggaatgtgtgccgagctttgtgctgacaatcatgccctcacaagagaagaccaggtctcttaatacagatagcagtaaatgctgtttgttataatattcccatatttttcaagatataagttgtgctatacaacatgtcaatgctggcaattattttgagagtgccctggaatcttcgtgctttatcttggttatcatcataaatggtctagagactctagaccagcatctgcattccttgtccgatgaactagtaacttggatcctttctggcaatgattttctgttaggttgtgacatgattgatagggtgggcttatgcatgctctgggtctgtgaactgaccattcatttgcttccagagatgaaagtagatgtgccacacaaaaatgagcactcttttgcattcttgttagagctatacaagtataatctcttaaaagctgctcatcagtacatgacactagtaccttgatgattttactgtatctgtttatgtaatttttttcttaataaatttgatatagtataattaaaattgagttgcctttgaattttcacttatatgttgcaatgtatttttgtctatattgcaataaatatattcccaatttctggtatatttacttattcttgaataggatgcatttgctatccaaagcaatgagcgtggaattgctgctcgtgacagtggtgcttttgcatgggagattattccggtaattttctccctcattgatgatactagacatgcttttcttggttttctgatggtcaatgttgtcgcccaggttcaagttcctgttggtagaggaaaacccccaacattaattgagagagatgaaagcctggataaggttttttttctgatttgacaaaatatttttaacaaaataaagcttgtagttgatcaaaggcaaaaagactggcaggcactttgatttattgttcttgcttcctccaaatgcaacgttcctcgcataatgagctttgctagcagttatttgtaagatcaatgcatgacagttttatttatgtcttgtgctattccttttgtgtcttagtttgacccagtaaaactaaagaaacttcgcccaagtttcaaggagaatgatggtacagttacagctggaaatgcttctagtataaggtagctgcttgaaatatttctgagacctttttgtcctacaaagtctttctgagaccttgtttttcggccatatgttgtttagctgacagatatgaaggacaacctatttcattgttgacagttaaattatattattgtattatgcatgcatttttaactgatatattatgcttgcattttgtcaacttcattgtttctctatttgtttttagactgcttgggtatgctctactctgtgaaatagatggtaattttttctttagaattggtacccaatcgatgtgaatgatttatcacataagaaagtaaaaacattttaaatgccttattatgcccattcaaacaacaaaagttgccctagaccttgtctgtctcactttgtactgtgtctatttttagctgaccagtactgtccggtgtactgcctactatggcttgtctagccttctgcaaccagtcatatctaatttgttttatatggatcagtgatggagctgctgcattagttttggtgagtgggcagaaggctcaagagcttggccttcaagtccttgcaaggatcaaaggttatgctgatgcagctcaagtaagccacagtaacaattgttagctctcctaagagtagaatgcgcttattctaattcacattgtgatctaaatattttaggatataggaagttatttttatctggaacgattttatgttactattttagatatcgaaatttatcaactattggaacttgtgatctggaatattattttgtaatgtggatgctgtttatacaggctccggagctttttacaaccactccagcacttgcaataccaaaggctatcgcaaatgctggattagagtcatcccatgttgatttctatgagattaatgaagccttttcggtatgcattgggtttctttatttgtaagccttttgttatgcattgagagcttattttacttattactttttttttgtaataatgtcttttttacttatcaatataggctgttgcacttgcaaatcaaaagcttcttggaattccttcagtaagtgtcacctgtattaaactgccattctttgtgcattttagaagttaaaacatcactttcagaaagtacatattggcccttttttgttatttgctatgcagcagcaacatgtaattgcattataacagcattatatgtactaacaacatatgtgtttgcaggaaaagattaatgttcatggaggagctgtatctttaggacatcctctcgggtgcagtggtgctcgcattttggttacccttattggtgtaagttctatcttaagatgcttgttttatcttttgagttacaatcccttttgtttaaaaaaatgtgcaatgtttttctagtaaaaaaatagatgatggtctttgagtaattgatgaattctgacatatgttaccgtatcatcatagggttcgtgatgaacagtaagcatcttcactattgctactaagtctacttccttagtgttttccaatgtgcaatgtttttcttgtataaagctgcaaatgtagagtttcacttgttgctggtgatcagtagtttctcttcattttctttaagcaaaaccttgagaacaatatggtgccatcatgttgggacatcaaatatatggtgcttgaccctcctaatcattgtttcttgttaacaggttctcagggcgaagagtggcaagatcggagttgctggtgtctgcaacggtggaggcggagcatcagctcttgttctggagctcgcataagaaatctagaccttgtaaggctcaaaacaccgaatatatctcaactcaaattgattcttttactagctggcaggagctaaccagtataaggtgctattactgttgtgcaatttgactaactgctgcaactgatattgcaggtatttagcaaaagttccctgaggtgatcttgtagtcttattttccgttgtagtagtcccatagaacatttcttaatttaatttggcaataaagcgaagtcgtgcttctgttggttgcatagtagagtatcatgtaataagagcaatggggatgtttcatagatatttttgaggatgctacagaaatattttatatactagtgagtgctcgtgcgttgcaacgggaatatataattctatgataacttatatacaaaatgtgtgctacattgttataagaaaatgtttcataatct

SEQ ID NO: 45 - DNA, 5881 bp, Zea mays
gggcagtctatactgcccccttaatagttagtagagatttggtacaactcacgagctagctcgctcgcagacgctccgaacttgatctgactcgtgagcctcaagttttttttctagccttaaccacatgcccacgaggatgattgttcgaggtgattagcaaacgcaaacgatatcaattgacattttttattagtttcattaggtttagagataaaattatatcatgtatgtcactcatctagtatcttatttgttatcataaatgttctaatcctttttacgtcacccgaatacaattttttactctttcatgtcatcgttgatgacatagtaagggactaagacatacaacattttacatttaacatttggccacgacatgtaagagtgagatattgaattcgagtaacatacgaggtacgatgaataaggtattacacaaaattacagtggcatatagtgaattgaattgttctatttttactttttttttgcctaacataaagcctattttatttagtactttctctgattcagctttaatttttatgatttattaattttattatatatctatatattgtatagattaaaaaataaaatagattatagatttaggaaaaattacattcgggtgatttggctgttgggtgttgcgttccctacttgctcttttcttcctccgcttcaacctgtccccagcgccccccgcgcacacactgtctttctctgcctttctttccctagcgccgcgccggcgacgccattcgatcaggccgcttcgccggcgacagcatattccaggtatgccgtcccttctgctccttctgcgagaattcaaacaccccgaactccccaaatctagtatttgtattcggatctgaccatttttcactgggcccgcccctgattcgcaggtcggttggttttggcacttcggaccggcggccatggcttccgacggcatcggccccagaggtattactgtttcatctcttcttgtgttcaaacagacagacgtcaagccgccgagaggaggtacaaatatagattttgggtaatgagcacgccattgcgcttccagcgatctgacatattgggaattcttgcttttttttgggtaccttgcaaggccgaaatttgacgcttttctgtttaattctagtgcctgtctgcatccattagggcatcctagctgctccatgctcgtgatctcgtccgtttgcttgattgaatccattgttttccaaagttcattgctactgcgaaatacgtttatatgattaccacaagttgtgttttttccttttcgggttgcacagagggtactgccatcattgttgttatagcgccatttggaacaagtgattcactggtactagtacagtatgtgcttttcatgtgtgtttggtttgtaccatcagatggaattttgagcgcggtttacaaattagtactatagatatactgtgaggtgcacactagatggttctgctttgttctacagtcagtaactttttcttccttgctcacagatgtatgtgttgttggggttgcacgcaccccaatgggcggtttccttggtgccttgtctcccttgcctgctacgaaacttggctctatagtaattcaaggtgagatccgaatcttctctgcatttacatccgagctctgaacatggtcatggctgggggctgttagctgctctggaaagagcaaacgtggatccagccctcgtgcaggaggtctactttggaaacgtcttgagtgctaatttggggcaagcgcctgcaaggcaagctgctctgggtgccgggataccaaactctgttgtttgcaccactgttaacaaagtctgtgcatctggcatgaaaggtttgaatcgaatttatctgtctgtccttgtgtactctgctcagagttcacagaagtgagagattacctgaccatgctcttgtttccctttcctatatgcagctactatgtttgcagcacagtcaattcaattgggtatcaatgatattgttgtggctggtggcatggaaagcatgtccaatgccccaaagtacattgctgaagctaggtatgcaattattacttggtggatatattcaatatcgagctgcataaaccaaatgatagtcttaagttatttggtagatacatgcatgcttacttatcttcattgcattttctaaatttgtttgtaagaaatgttgattcaccagcagcgaggctattaacgaagtggccagttttgttgtgaaagtatattctgttcatgtttaaagtgcatttcaactgctttaatccaataagcttgctacttacaattgcaggaaggggtctcgttttggtcatgacacacttgttgatgccatgcttaaggatgggctttgggatgtatacaatgattgtgccatgggaatgtgtgccgagctttgtgctgacaatcatgccctcacaagagaagaccaggtctcttaatacagatagcagtaaatgctgtttgttataatattcccatatttttcaagatataagttgtgctatacaacatgtcaatgctggcaattattttgagagtgccctggaatcttcgtgctttatcttggttatcatcataaatggtctagagactctagaccagcatctgcattccttgtccgatgaactagtaacttggatcctttctggcaatgattttctgttaggttgtgacatgattgatagggtgggcttatgcatgctctgggtctgtgaactgaccattcatttgcttccagagatgaaagtagatgtgccacacaaaaatgagcactcttttgcattcttgttagagctatacaagtataatctcttaaaagctgctcatcagtacatgacactagtaccttgatgattttactgtatctgtttatgtaatttttttcttaataaatttgatatagtataattaaaattgagttgcctttgaattttcacttatatgttgcaatgtatttttgtctatattgcaataaatatattcccaatttctggtatatttacttattcttgaataggatgcatttgctatccaaagcaatgagcgtggaattgctgctcgtgacagtggtgcttttgcatgggagattattccggtaattttctccctcattgatgatactagacatgcttttcttggttttctgatggtcaatgttgtcgcccaggttcaagttcctgttggtagaggaaaacccccaacattaattgagagagatgaaagcctggataaggttttttttctgatttgacaaaatatttttaacaaaataaagcttgtagttgatcaaaggcaaaaagactggcaggcactttgatttattgttcttgcttcctccaaatgcaacgttcctcgcataatgagctttgctagcagttatttgtaagatcaatgcatgacagttttatttatgtcttgtgctattccttttgtgtcttagtttgacccagtaaaactaaagaaacttcgcccaagtttcaaggagaatgatggtacagttacagctggaaatgcttctagtataaggtagctgcttgaaatatttctgagacctttttgtcctacaaagtctttctgagaccttgtttttcggccatatgttgtttagctgacagatatgaaggacaacctatttcattgttgacagttaaattatattattgtattatgcatgcatttttaactgatatattatgcttgcattttgtcaacttcattgtttctctatttgtttttagactgcttgggtatgctctactctgtgaaatagatggtaattttttctttagaattggtacccaatcgatgtgaatgatttatcacataagaaagtaaaaacattttaaatgccttattatgcccattcaaacaacaaaagttgccctagaccttgtctgtctcactttgtactgtgtctatttttagctgaccagtactgtccggtgtactgcctactatggcttgtctagccttctgcaaccagtcatatctaatttgttttatatggatcagtgatggagctgctgcattagttttggtgagtgggcagaaggctcaagagcttggccttcaagtccttgcaaggatcaaaggttatgctgatgcagctcaagtaagccacagtaacaattgttagctctcctaagagtagaatgcgcttattctaattcacattgtgatctaaatattttaggatataggaagttatttttatctggaacgattttatgttactattttagatatcgaaatttatcaactattggaacttgtgatctggaatattattttgtaatgtggatgctgtttatacaggctccggagctttttacaaccactccagcacttgcaataccaaaggctatcgcaaatgctggattagagtcatcccatgttgatttctatgagattaatgaagccttttcggtatgcattgggtttctttatttgtaagccttttgttatgcattgagagcttattttacttattactttttttttgtaataatgtcttttttacttatcaatataggctgttgcacttgcaaatcaaaagcttcttggaattccttcagtaagtgtcacctgtattaaactgccattctttgtgcattttagaagttaaaacatcactttcagaaagtacatattggcccttttttgttatttgctatgcagcagcaacatgtaattgcattataacagcattatatgtactaacaacatatgtgtttgcaggaaaagattaatgttcatggaggagctgtatctttaggacatcctctcgggtgcagtggtgctcgcattttggttacccttattggtgtaagttctatcttaagatgcttgttttatcttttgagttacaatcccttttgtttaaaaaaatgtgcaatgtttttctagtaaaaaaatagatgatggtctttgagtaattgatgaattctgacatatgttaccgtatcatcatagggttcgtgatgaacagtaagcatcttcactattgctactaagtctacttccttagtgttttccaatgtgcaatgtttttcttgtataaagctgcaaatgtagagtttcacttgttgctggtgatcagtagtttctcttcattttctttaagcaaaaccttgagaacaatatggtgccatcatgttgggacatcaaatatatggtgcttgaccctcctaatcattgtttcttgttaacaggttctcagggcgaagagtggcaagatcggagttgctggtgtctgcaacggtggaggcggagcatcagctcttgttctggagctcgcataagaaatctagaccttgtaaggctcaaaacaccgaatatatctcaactcaaattgattcttttactagctggcaggagctaaccagtataaggtgctattactgttgtgcaatttgactaactgctgcaactgatattgcaggtatttagcaaaagttccctgaggtgatcttgtagtcttattttccgttgtagtagtcccatagaacatttcttaatttaatttggcaataaagcgaagtcgtgcttctgttggttgcatagtagagtatcatgtaataagagcaatggggatgtttcatagatatttttgaggatgctacagaaatattttatatactagtgagtgctcgtgcgttgcaacgggaatatataattctatgataacttatatacaaaatgtgtgctacattgttataagaaaatgtttcataatctatacacaaagatgagatttctgcaaagaataccatgccacatcactaaaatatgaatggctcacttatcccttataacagcagccttgtcttt

SEQ ID NO: 46 - DNA, 1628 bp, Zea mays
gtgttgcgttccctacttgctcttttcttcctccgcttcaacctgtccccagcgccccccgcgcacacactgtctttctctgcctttctttccctagcgccgcgccggcgacgccattcgatcaggccgcttcgccggcgacagcatattccaggtcggttggttttggcacttcggaccggcggccatggcttccgacggcatcggccccagagatgtatgtgttgttggggttgcacgcaccccaatgggcggtttccttggtgccttgtctcccttgcctgctacgaaacttggctctatagtaattcaagctgctctggaaagagcaaacgtggatccagccctcgtgcaggaggtctactttggaaacgtcttgagtgctaatttggggcaagcgcctgcaaggcaagctgctctgggtgccgggataccaaactctgttgtttgcaccactgttaacaaagtctgtgcatctggcatgaaagctactatgtttgcagcacagtcaattcaattgggtatcaatgatattgttgtggctggtggcatggaaagcatgtccaatgccccaaagtacattgctgaagctaggaaggggtctcgttttggtcatgacacacttgttgatgccatgcttaaggatgggctttgggatgtatacaatgattgtgccatgggaatgtgtgccgagctttgtgctgacaatcatgccctcacaagagaagaccaggatgcatttgctatccaaagcaatgagcgtggaattgctgctcgtgacagtggtgcttttgcatgggagattattccggttcaagttcctgttggtagaggaaaacccccaacattaattgagagagatgaaagcctggataagtttgacccagtaaaactaaagaaacttcgcccaagtttcaaggagaatgatggtacagttacagctggaaatgcttctagtataagtgatggagctgctgcattagttttggtgagtgggcagaaggctcaagagcttggccttcaagtccttgcaaggatcaaaggttatgctgatgcagctcaagctccggagctttttacaaccactccagcacttgcaataccaaaggctatcgcaaatgctggattagagtcatcccatgttgatttctatgagattaatgaagccttttcggctgttgcacttgcaaatcaaaagcttcttggaattccttcagaaaagattaatgttcatggaggagctgtatctttaggacatcctctcgggtgcagtggtgctcgcattttggttacccttattggtgttctcagggcgaagagtggcaagatcggagttgctggtgtctgcaacggtggaggcggagcatcagctcttgttctggagctcgcataagaaatctagaccttgtatttagcaaaagttccctgaggtgatcttgtagtcttattttccgttgtagtagtcccatagaacatttcttaatttaatttggcaataaagcgaagtcgtgcttctgttggttgcatagtagagtatcatgtaataagagcaatggggatgtttcatagatatttttgaggatgctacagaaatattttatatactagtgagtgctcgtgcgttgcaa

SEQ ID NO: 47 - DNA, 1714 bp, Zea mays
aagagcccctcgggcagcaggatcttccccctccccaaaaccaaaccagctgcctccgacagcatccaccttttcctcccccaaaccatggacttctccaccggcgggagcgtgagcgggggcggcggaggcgccagcgacggccccgcgcaggcggagcgctggctggagatcgccgagaagctcctcgcggcgcgcgacctcgtcggctgcaagcgcttcgcggagcggtcggtggaggcgaacccgctcctcgccggcgttgacgaactcctcgccgtcgccgacgtcctcctcgcttcccagttcatgggcacctcgggccagccggacccgctcgccatcctccagctgccgcccggagtcagccccgaccaggccgccgtgtcccgcgccttccgccgcctcgcgctcctcctcggtcccagcaacccgcacccgggagccgagatggcgctccgcctcgtcaacgacgcctacgccttcctctcggatccctctcgccgccccccgccgcccgccgatcccgccactggtaccccttactcctcccagtatcccgccgcggccgctcccgcctccgacaccccggagttctggacggcgtgccccttctgctgctacgtgcaccagtacccgcgcagcctgatcgggcgcgccctcaagtgccccaacgcgggctgccgccgcggattcgtggcttctgagctcccgaccccacccacggttgtgccgggcactgaaatgtaccactgcgcctgggggttcttccccctcggatttcccaacgcggccgacctgggtgccaactggaagccattctacaagatgttcccttggaacacggctcccagtggccaaggtggtggtggtaggagtcacggaaaccatggtggtaggcagccacagaatgacagtgctcgtggtggctcttctagaggtaggatcaagaagacgacggcccgcaagaaggtcggggtagggctcaggagacgttctcttggtgtggagagtggcattgattcttcgatgctcgggcaggaaggctgggctggggatgagaacgctggagatggaagggccgaggaggtgaggagaattaacataaatgaggcagcacatgctacagatggcactggtagggttaatgttagcggtgctggcggagttgaagatatcggcaactttcatatcgatgttgatgcatccgaggatatattggggaatttgcacaacatgcacttcttgagggtggacaatcttggacggatgatttaactgttgttatggtttactggggctatgattagccaggccgactcttgctgttcaagtgttcatttgagtgtaattgttccatccctgttatgtaatgttgtagttgtagacttgtagtctacctggtacctgtagttacttaacatcaggcagggaaaaatttgtatgttcattagatggagatacatgccatttgccttagcaaacacactttgtggaggtttccagtgatgggataatgcttcgcagaggtgtggttggactggcaatgcttaccatgccacttctggtttyttcctggcatggtgacacaaaatgttgttgagatcaagtaagtgaattatgttctgctttctgagttcggtaaacttctttggctacaaaaggactaagcttagttatgctaacttgttgatttggttgtgatcattgcatc

SEQ ID NO: 48 - DNA, 9828 bp, Zea mays
tggcctcagcatgtttgcaaaatgaatcagtaaggaaaaagaacacggctgcatcatctatatgatacctccaagtgaacataaaggacaacatcatcgaccaatttaatataaatccaaagcaaaccacatgaaaatcaaactcgcagcaggtataacatgaacaacacactgtaccaaaccctaactcatgaagcatgaaccagaaaatagaacgattgggggttgatttcaccttggggtcaaggtcgtagcaacggagacggagcagacctagaagtataggaagcaaatcgaccagagacgaagcgacgaagcagatgcccaacgccacggagtcctggcaccaggcggagctggacgcagccgcgacgcacagccactcgccgccggtctctcacgagggagggagggggtggaagaagaacgagcagcgagaggaggggaaaaggagggtgcaccgtcgccatatatagccgcaagaggattcaccggagcgctccttcccgcgcgcgcgaaaacctcaccattcccgcgcgagcccgcgcgagctcccgccagccacctcgcccgccgccacattccgccagtgcgccgcgcgcagccgagctcccaggaaacgaaccctagccgcgtttcctgggagccacccaggaaacaggctgttttcagccaggctgcgaaacgggccaaccttgcaaacaaggttagttgtagcccacgggcacaatcgggctactgggccatcctccgaaacacgcccttggtgatctctggtggcgaagcgatacgatacgatggccggccgtagtacgtcccgtgggtggccgctgacgtgacgagaaacagtcggtcggcggccagccagtaacgtgacactcgccatctgcttccatcttttgtggttttttcttctctagacttgactgcatgcagccaagaaccagaaaccggacgaccgaccgacgacggcgacgggtcgtcgtgcaccgccacacgggggtcatacgatacgacacgacacgttccgccgcgagatcgaggtcgatgagtccgaggctctcggctcccaagtcccaacaagctgcaccggctcgacgaggacgacgtactgtacgaacagaacaacagccagaggccggccggccggacgaccgacggtcgccgtcgtgcaccgtgcacggtgcaccacgtctcatgccgtctggcgtgtgggtgacgaatcactgaaactgaaagggtaggcagcacagcacatccacacacatgttctttgcctatcacacgctctttgtaaaattttagtacactggtgacaataggcggaccgagtccaacatcaacaaaaaaatatatatatactggacgttcgttagccgggaccatttttcccccaaaaggaaccaactacagcaggctgaaataaacgttcctccctctatgccaaaataaaattcgtattagtaaattagtggttcatataacatttgatgtatgtgttttgtatatatatacatgcctatatttattaacatttatttgaatatagatataaaaacacagagctaaaacgattactaataaagttaacttgacgctgcagtgttgtttttttttataaactctgttcaagttagagaaatctgatttgtagcagctcttgacttcaacagagggatcagaataactataaagctccagtaaatagattacagaatacagcttccctgtttctttcaacaatacggcagtttagaattttttatgtaacaaagctagagagtttgtgttttatgtaactaagccaaagtgtgggtaagtgatatacgataaagtagcatgacacacggaagttccactcatggaatggctttgttcgtttacaccaatcccgctctagattagcatggattggaattaaatccatgcctcaatccatgccccaaaataatccatgactacttaattttttttattcggttaaacccatcatggaatataacccaaaggtttgggaattttttaaactatggaagacatggattctatccatagcccattaggtatggaacaaatccatgagatattgcacaagtttacattagaattcatggatcaaaagaataactagctttgaaagtcacatggatttgttgatggatttaatcccaccatgggattaggtgtgagatatggattcacccaatccatacccagattaaatccatggtgggattatatcccatataaccgaacaagaccttatgtggaaatataactaaataggaggacaacaagcttacttctattcaagcacagctctagcaagggactatgacaatacagataaaccaagatatagtaaggtaggacacaatagcattccagggtgcaccacgagcgctatgctttaacaaatagacctaacatcatggagtacatagattagggataaaaacaggtacccgaactcttaaaacaaatctaatattttaaaatagatatgtataaaatttaatcataatctttccttctgttataagcacactattatatataagaataaattttacatagattgttttatacattatttactctttacaacaaaaagatgaaaaaatgtttgtatccgtatccgaatgctacccaaattttatatctatcattttaaaaaatatgataaatttgatgtttattttttataaatctttacaagttcaatgctaaaaacaagaatattaatttgtctagcagattctatatcatatttattcactatcaaagaaaaaaataccaaaaaactggtatgcgaataggtacccgttttcatccctacataggatggacatggttgtcaccaccttccaactatcattaactatttagaggcctaaccacattccggtacccggtagagtaaacaccactgaaaggccctagtttgattttggtaaccgagtgacaacctaggtggactaatatattttctatgttgagatacacaggtgattagtccacaagtagactagtttgagatacttaaatcatgatggtgaaatgcttggatttattgtaaacctcaactaggtgtatgtgagacatcacatggtgtcttgtggataggtgcaggcagtggcggagccaggatttctgtaagtgtagggccaatataacactaacaaatatttatatcagctagaaaatcttaaatcatgcaaatgtatagataatgacacatatgaccatgaacggattatacaaattctctcattccttcagaacatatttgggtccctagcaatttttcggctcaagagtagggcccaagccctaatggccctatgcctgtctccgccactgggtgtaggatatcaagagacatggtttgggtatgaaggactgattgtaaaagtgattgacaagttagatactttgaggcgatggaccacatgtggcagagaagcttgagcaaggacttggcaccgatcgaccaaggaaacaataaagaccaaatgaagttgcgataaataaagtaatgaggccacaatggtaacatgaagtggaccatatcattcaaagaagatcaagccaattgtttattcatgttgatggtcaagtggcttgatgaagtatgatggaggaacttcatgatatggttaatgatcaaaggtagcatggttggctacatctatggatgatcattgcccatcatgtgatgaggttggatgcttgtataacatcatcaacattaagatgaaatggaatgtgcaagacaaaggtattgtccaagattgttctgtagtgattatgcaggtatgtcacgagatcgagagcatagtgattatgtaggtatttcacgagatcgatagcatatatagtgattatacgggatatgtcatgggatcgagagctaaaggttagggcatgagagacatgaggatttatacatgtttggactctcaatgtcagacaatactttttgtcttgtgtgtgttgttatatgttcggaacgatcacagagttttcccgtccctctttttatattctaaggagggatagatgttacacggtaagcatagagccgattatcaagttcatgatggaatcaagtcaattgccaagttgtacacaagtccaatttacggcttatctcatattcagttgagatctttaaaatctatcctagtttaatcattgattctttggacttatggccggacgcataggtccttctgcttagcctcttctttataaagcttgatttaggtactcatgcatattattgacaatagcttcagactttgtttgacgataaaaaagactctctatatatgagagcatccatacaaggttttgaccactttaggacgaaacttgaagatggagagatatgagaaaatacaatgtcgtttccatctctactcacagccgtgagtccatacacgagttgtttttatgttcaatttccacggtcatgtccctgtatttaaatgataaaaaaactaaaattatatttaaatataagatatgacatatggatgttggctataaacctatattcacacacctaactcatggttctatagtcgtcgtgcatcacccttctcattcccgtttatgcaaaaataaagagaaaatatgcatgattggggatttgaactttagttgtaggatctaagttcataccctcctatccaacagagcacatatatttttatgtttcattaaaaacaaagtatactcatgtcttatataaaaaccgtttcaacgaatgaacatctcattagtgatatttaaaaactatagcaatgcataagcaactaactactcaaaaaaatgcaacctgaatacttcctttgcttctccacacatgaaatgaaagaaactgaaataagaaacgggcaaacggcgctgcaaaagcgggaaatcccttttccttgctgatagtgatacccggtcaaaacccaccgagacggcgagacgcggggagcgggtacatacacactgacacacctcacgcgagccgagacgcccagctcaccgccccaccgagtcccacagtctcagaggccacctcgagccccccctgccccgcaagccgcacccgccgctccctccgccatctgcgctgcgctgctctgctctgcggtgccaggctgccagccagtgccggcgcgcgcccgctgccgccccgacgggcccaccgttctcttctctccgcgctgcgcgccggctgggctgcaggtcagttaatgcgcccgtgacaggcggcgtcggggaggccaagggcggtgccgggttaatcccgccgtctctcgaggcggcgcccgcggaggaccaggcgggagggggagacggtgaggcgcggccatggggggcgccaaggcggaggacaaacccgccgccgccgctgcagaagattggtgctaccaatttggaaacaaggttcgatttcttcaccatttgcactcctctgcaagactgggacacgtttccgggtttcgttctgcctgggcggcgacaaatctcatggcaaattgcctttgtggggctcattccctgggttcacactccaaatccttccttgcgaccttctctcagccgtcgcgctttccgtggcaagccttttggaaccctgatctgaagtgtcactcagatcaatgcagtcgcattgattctattcgtttcctgtttccgtttcccccttttaacgtgtctgctagttccaagtcccgagcgttttccgttctctgtttcagaattgaagcttgttaagttctgttttttttacaatccttcgtttttgtcccagtcctttctattcctggagaagttaggaatctgttgttctcctgttccatttctcctttctattcctggagaagttaggaatctgttgttctcctgttccatttctcggtgcagtattagttgcagaacaggaatccacttgatttgtcagtttaattatgcttgtgtcacctcagatgtgtcatattgattatgactgcatttttgtcagctgtaatatgcgtgttggcttgcatttgtttctctctttattagtactaccagcattttcggtcagtattttttgtcttccttgctgaagaatgagaaggaaagctgtcatactcctcgtcgggatagcttcatttattaaggcagctgggcgacagaatatatgggaatgtacttgaacttcacaaaaaagggccttttcatcccttgccgtgtcttccatgttggtaaaaaggctagtagctgaattgaatagtacgtgctcattttaactaccctgaggactagatagatcttgaagttttatttgtttatttctttttatttctgcttatatagatgtaggatgtagccaaatggatgcttctcagctcacattgaacattaatgtttgtgttgtttgctgaaaggttttttactgtagcagaaggttacaaaataacagatcttacctcaaaaaagggctgcaatgtatatatactggcactgaaccgcgtatgcgcagtgcaacctgctgattggttttgtactggtcggatctgtttgcaggatgcatttgacttgaagcccccgaaaaaatcaccgatcgcgttgagaacggttgtcttcgctatgactatgttatgcgggatatctatttgctcaatgtgcatgaagcaactagggagtgatggctggtcaagagttgtcaagattgaagttgtggaacaaccatgtaataagtccattgctcctctttcggaggctcaatttgtgcgctatcctcaaccgataacttacagcaggtgagatctgcactgtggtaagattgagcaatctcgtttgtttaatgcctaatgcataattttttatttctagggaggaatgcaagtgcaatgctgtccggtcctttgcaattatatcatcgcagcgatctggaagtggctggtttgaaacacttcttaacagccacatgaatgttagctccaatggtgaaattttctctagaaaagaaaggaggagtaacatttcctctataatagataccctggataaagtgtacaatttggactggaacagtagcgcttccaagaatgagtgcactgcagctattggcttcaagtggatgctaaatcaggtgcggactaaaacatgcagtatagataatttatttggatgatcctttttcatttatttttccatttagttccagtatgtttcaattattagtatgtgtagtctcctaaacggcctacatgttctcaactgtagatgctaaatgttattgcatattgcgccaaactttcctcaagtccatgtaactatttttttttgggaatccactttagggcttgctcgttttagtgccaatccatgtggattggacgagattggatgagtttaaatccataagaagtcaaaatccttcttaaaattttccaatctcttccaatccatgtgggatgcgaataaccgaacaaggccttatggaactgtcggtagctagtttagttttctgacttgctgtcagatcctgcattttagacaaattttctctctctcgaacatgcatgagaactgcaaatgcatatggagtaatatttgatagattctgtagtgtgtccagtagactgattataatctacatgtcaagcatgtttgtttcagggcttcatctaatttgtgcgagaacgaacttttttcctggtagacagattgcctaaccaaaccatgaatattggccaaacataggtttagagactggaaacaaaacaggcattgtagctagagagtggaaacaaaggagcatttcttctgaacggggttggggtgtatgttttcagggcctcgtggcaaaccatgcggacgtagtcgactacttcaaccgaagaggagtctctgcgatatttcttttcagaaggaacctgctccgccagttggtatcacaggtagcgaacaaccacgacaggttacttaagcaactaaacggaacgcacaaggcccatgtccacacgaagcgtgaggttagtaatgctagctaagaaacggatatggcagcaagtctctgagctgatctgatctctctctgtgtttgacgtgtcgttcgttctcgctccacaggcccatatactggcaagatacaggcccaggctcaacacgacgtcactgatatggcagctgaaacgagctgacgagtacactcgcgacgctcttgagaacctaaacaacacccggcacatgagcgtctactacgaggacgtcgtccgcaacagaacagtgcgttctcgctgatgcccttcccttgtctgttcccttccgttggttgtgtcgcttaccatcgctgctgcactgcagaagctcttggatgtcctggatttcctcggagtgccgaggaggaagctggtgagccggcacgtgaagatacacacgaagccgctgtcggagcagatcgagaactgggacgaggtctacagcgccctcaacggtacccagtacgagggcttcctgaatgccgctgactatctagtataacatcacgtttctggatgtagatagtgtgcgtgtgattctttcgtttcttgtttgtttctggcagaaattttgatgcggggtaggcgccttttgccgtgcatggttgcattctcggtaacctgatgctcctgtaactaaccctccagcttctctgatctttgtatttgccttgggtgtttgctgatgttctttcaaactatttgaaatcgggctgtcggagttccagatcccgggcggcaggatagttgatgtgacctagataaatgtacaagacacatcacaaatatataaaatatttctgtagtatcctcacaaatatatcaaaaatatttctgtagctcttattacatgatactctactatgcaaccaacagaagcaatatctcctcagggagcttttgctttattgccaaattaaattaagaaatgttctatgggactactacaacggaaaataagactacaagatcacctcagggagcttttgctaactacctgcaatatcaaggtgcagcagttagtcaaattgcacaacagttgtaaaaggaaaaaatacaacttaattaggcctagctgaatatgcgaccatattacagtttgataatagcaccttatactggttagctcctactgccagctagtaaaagaatcaatttgagttgagatatattcggtgttttgagtcttacaaggtctagatttcttatgcgagctccagaacaagagctgatgctccgcctccaccgttgcagacaccagcaactccgatcttgccactcttcgccctgagaacctgttaacaagaaacaatgattaggagggtcaagcacaatatattttgatgtcccaacatgatggcactatattgtgcccaacgttttgcttaaagaaaatgaagagaaaaagaaactattgatcaccagcaacaagtgaaacaagggatgagccgatatcaatgtgaaactctacatttgcagctttatacaagattctatttgcagataatttgcacattggaaatcactaagggcttgttcggttgcgagaggattggaggggattgagggggattaaatcccctcctattcaattttaactagaaggggatttaatccccttcaatccccctcgaaccacttgtaaccgaacatggcctaaggtagtgtttggtgcagggatggggtggcttgatccaacatactccctatgtttcaaattataagatgtttttactttttctagatttgtagtttttattgcgataaacattatgtctcagtacacgtagtaaaa

SEQ ID NO: 49 - DNA, 11900 bp, Zea mays
gatataatgaaaaaaccaattaaaaacgtgtctcgatatgcgtgcacgagtaaagagctggctgagcggagcctggccgcgcgcgtgcggtcgcgcgatgcgtttctgccgggcctggctcgcggcgctttaagttccgtgctagcctgtctcgtgcgatacaacgaaccaaacaaacactactttttgcatgtgtagatgcagctgcaccactggagaaggcaaccaaacgccccctaaggcagctgggcgacagaatatatgggaatgtacttgaacttatcaaaaaagggccttttcatcccttgccgtgtcttccatgttggtaaaaaggctagtagctgaattgaatagtacgtgctcattttaacttccctgaggactagatagaccttgaagttttatttgtttatttctttttatttctgcttatatagatgtagccaaatggatgcttctcagctcacattgaacattaatgtttgtgttgtttgctgaaaggtttttttactgtagcagaaggttacaaaataacagatcttacctcaaaaaagggctgcaatgtatatatactggcactgaaccgcgtatgcgcagtgcaacctgctgattggttttgtactggtcggatctgtttgcagratgcatttgacttgaagcccccgaaaaaatcaccgatcgcgttgagaacggttgtctttgctatgactatgttatgcgggatatctatttgctcaatgtgcatgaagcaactagggagtgatggctggtcaagagttgtcaagattgaagttgtggaacaaccatgtaataagtccattgctcctctttcggaggctcaatttgtgcgctatcctcaaccgataacttacagcaggtgagatctgcaactgtggtaagattgagcaatctcgtttgtttaatgcctaatacataatttttaatttctagggaggaatgcaagtgcaatgctgtccggtcctttgcaattatatcatcgcagcgatctggaagtggctggtttgaaachcttcttaacagccacatgaatgttagctccaatggtgaaattttctctagaaaagaaaggaggagtaacatttcctctataatagataccctggataaagtgtacaatttggactggaacagtagcgcttccaagaatgagtgcactgcagctattggcttcaagtggatgctaaatcaggtgcggactaaaacatgcagtatagatttatttggatgaccctttttcatttatttttccatttagttccagtattgcatattgctccaaactttcctcaagtccatggaactatttttttttgggaatccactttagggcttgctcgtcttagtgccaatccatgtggattggacgagattgaacgggtttaaatccgtaagaagtcaaaatccttcttaaaattttccaatcccttccaatctatgtgggatgcgaataaccttatgggactgtcggatagctagtttagttttgtgacttgctgtcagatcctgcattttagacaatttttttctctcgaacgtgcatgagaactgcaaatgcatatggagtaatatttgatagattctgtagtgtgtccagtagactgattataatctacatgtcaagcatgtttgtttcagggcttcatctaatttgtgtgagaacaaacttttttcctggtagacagattgcctaaccaaaccatgaatgttggccaaacatagagttagagactggaaacaaaacaggcactgtagctagagagtggaaacaaaggagcatttcttctgaacggggttggggttggggtgtatgttttcagggcctcgtggcaaaccatgcggacgtagtcgactacttcaaccgaagaggagtctctgcgatatttcttttcagaaggaacctgctccgccagttggtatcacaggtagcgaacaaccacgacaggttacttaagcaactaaacggaacgcacaaggcccatgtccacacgaagcgtgaggttagtaatgctagctaagaaacgtgttcgcggctaatgtctcactctcacagcaagtctctgagctgagctgatctctgtctgtgtttgacgtgtcgttcgttctcgctccacaggcccatatactggcaagatacaggcccaggctcaacacgacgtcactgatatggcagctgaaacgagctgacgagtacactcgcgacgctcttgagaacctaaacaacacccggcacatgagcgtctactacgaggacgtcgtccgcaacagaacagtgcgttctcgctgatgccctttgtctgttcccttccgttggttgtgtcgcttaccatcgctgctgcactgcagaagctcttggatgtcctggatttcctcggagtgccgaggaggaagctggtgagccggcacgtgaagatacacacgaagccgctgtcggagcagatcgagaactgggacgaggtctacagcgccctcaacggtacccagtacgagggcttcctgaatgccgctgactatctagtataacatcacgtttctggatgtagatagtgtgcgtgtgattctttcgtttcttgtttgtttctggcagaaattttgatgcggggtaggcgccttttgccgtgcatggttgcattctcggtaacctgatgctcctgtaactaaccctccagcttctctgatctttgtatttgccttgggtgtttgctgatgttctttcaaactatttgaaatcgggctgtcggagttccagatcccgggcggcaggatagttgatgtgacctagataaatgtacaagacacatcacaaatatataaaatatttctgtagtatcctcamaaatatatcaaaaatatttctgtagctcttattacatgatactctactatgcaaccaacagaagcaatatctcctcagggagcttttgctttattgccaaattaaattaagaaatgttctatgggactactacaacggaaaataagactacaagatcacctcagggagcttttgctaactacctgcaatatcaaggtgcagcagttagtcaaattgcacaacagttgtaaaaggaaaaaatacaacttaattaggcctagctgaatatgcgaccatattacagtttgataatagcaccttatactggttagctcctactgccagctagtaaaagaatcaatttgagttgagatatattcggtgttttgagtcttacaaggtctagatttcttatgcgagctccagaacaagagctgatgctccgcctccaccgttgcagacaccagcaactccgatcttgccactcttcgccctgagaacctgttaacaagaaacaatgattaggagggtcaagcacaatatattttgatgtcccaacatgatggcactatattgtgcccaacgttttgcttaaagaaaatgaagagaaaaagaaactattgatcaccagcaacaagtgaaacaagggatgagccgatatcaatgtgaaactctacatttgcagctttatacaagattctatttgcagataatttgcacattggaaatcactaagggcttgttcggttgcgagaggattggaggggattgagggggattaaatcccctcctattcaattttaactagaaggggatttaatccccttcaatccccctcgaaccacttgtaaccgaacatggcctaaggtagtgtttggtgcagggatggggtggcttgatccaacatactccctatgtttcaaattataagatgtttttactttttctagatttgtagtttttattgcgataaacattatgtctcagtacacgtagtaaaagctataaatctaacaatgccaacatcccaagacgtcttataatttgggatagaggaagtagacctagtagcaatagtgaagatgcttactgttcatcacgaaccctatgatgatatggtaacatatgtcagaattcattatttactcaaagaccatctatttttttactagaaaaacattgcacattttttttaaacaaaagggattgtaactcaaaaggtaaaacaagcatcttaagatagaacttacaccaataagggtaaccaaaatgcgagcaccactgcacccgagaggatgtcctaaggatacagctcctccatgaacattaatcttttcctgcaaacacatatgctgttagtacagataatactgttataatgcaattacacgttgctgctgcatagcaaataacaaaaaagagacaatatgtactttctgaaagtgattgtttaacttctaaaatccacaaagaatggcagtttaatacaggtgacacttactgaaggaattccaagaagtttttgatttgcaagcgcaacagcctatattgacaagtaaaaaagacattattacaaaaaaagtaataagtaaaataaactctcaatgcataacaaaaggcttacaaaaaatgtgagtaaaagaaactcaatgcataccgaaaaggcttcattaatctcatagaaatcaacacgggatgactctaatccagcatttgcgatagcctttggtattgcaagtgctggagtggttgtaaaaagctccggagcctgtataaacagcatccacattacaaaataatattccagatcacaagttccaatagttgataaatttcgatatctaaaatagtaacataaaatcgttccagataaaaataacttcctatatcctaaaatatttagatcacagtgtaaattagaataagcgcattctactcttaggagagctaacaattgtttctgtggcttacttgagctgcatcagcataacctttgatccttgcaaggacttgaaggccaagctcttgagccttctgcccactcactaaaactaatgcagcagctccatcactgatccatataaaacaaattagatgactggttgcagaaggctacacaagccatagtaggcagtacaccggacagtacttgtcagctaaaaatagacacagtacaaagtgagacaaacaaggtctagggcaaccatgaagaaatttaaaaggtagggcaacttttgttgtttgaatgggcataataaggcatttaaaatgtttttactttcttatgtgatattgtgataaatcattcacaccaattgggtaccaaatctaaagaaaaaattaccatctatttaacggagtagagcatacccaagcagtctaaaaacaaatagagaaacaatgaagttgacaaaatgcaagcataatatatcagttaaaaatgcatgcataatacaataatataatttaactgtcaacaatgaaataggttgtccttcatatctgtcagctaaacaacatatggccgaaaaacaaggtctcagaaagactttgtaggacaaaaggcctcagaaatatttcaagcagctaccttatactagaagcatttccagctgtaactgtaccaccattctccttgaaacttgggcgaagtttctttagttttactgggtcaaactaagacacaaaaggaatagcacaagacataaataaaactgtcatgcattgatcttacaaataactgctagcaaagctcattatgcaaggaacgttgcatttggaggaagcaagaacaataaatcaaagtgcctgccagtctttttgcctttgatcaactacaagctttattttgttaaaaatattttgtcacgtcagaaaaaataccttatccaggctttcatctctctcaattaatgttgggggttttcctctaccaacaggaacttgaacctgggtgacaacactgaccatcagaaaaccaagaaaagcatgtctagtatcatcaatgagggagaaaattaccggaataatctcccatgcaaaagcaccactgtcacgagcagcaattccacgctcgttgctttggatagcaaatgcatcctattcaagaataagtaaaattaaatataccagaaattggaaatatatttattgcaatatagacaaaaataaattgcaacatataagtgaaaattaaaaggcaactcaattttaattatactatatcaaatttattaagaaaaaaattacataaacagatacagtaaaatcatcaaggtactagtgtcatgtactgatgagcagcttttaagagattatacttgtatagctctaacaggaatacaaaagagtgctcatttttgtgtggcacatctactttcatctctggaagcagatgaatggtcagttcacagacccagagcatgcataaaagcccaccctatcaatcatgtcacaacataacagaaaatcattgctagaaaggatccaagttactagttcatcagacaaggaatgcagatgctggtctagagtctctagaccatttatgatgatgaccaagataaagcacgaagattccagggcagtctcaaaagaattgccagcattgacatgttgtatagcacaacttatatcttgaaaaatatgggaatattataacaaacagcatttactgctatctgtattaagagacctggtcttctcttgtgagggcatggttgtcagcacaaagctcggcacacattcccatggcacaatcattgtatacatcccaaagcccatccttaagcatggcatcaacaagtgtgtcatgaccaaaacgagaccccttcctgcaattgtaattagcaagcttataagcagttgaaatgcactttaaacatgaacagaatatactttcacaacaaaactggccacttcgttaatagcctcgctgctggtgaatcaacatttcttacaaacaaatttagaaaatgcaatgaagataagtaagcatgcatgtatctaccaaataacttaagactatcatttggtttatgcagctcgatattgaatatatccaccaagtaataattgcatacctagcttcagcaatgtactttggggcattggacatgctttccatgccaccagccacaacaatatcattgatacccaattgaattgactgtgctgcaaacatagtagctgcatataggaaaggaaaacaagagcatggtcaggtaatctctcacttctgtgaactctgagcagagtacacaaggacagacagataaattcgattcaaacctttcatgccagatgcacagactttgttaacagtggtgcaaacaacagagtttggtatcccggcacccagagcagcttgccttgcaggagcttgccccaaattagcactcaagacgtttccaaagtagacctcctgcacgagggctggatccacgtttgctctttccagagcagctaacagcccccagccatgaccatgttcagagctcggatgtaaatgcagagaagattcggatctcaccttgaattactatagagccaagtttcgtagcaggcaagggagacaaggcaccaaggaaaccgcccattggggtgcgtgcaaccccaacaacacatacatctgtgagcaaggaagaaaaagttactgactgtagaacaaagcagaaccatctagtgtgcacctcacagtatatctatagtactaatttgtaaaccgcgctcaaaattccatctgatggtacaaaccaaacacacatgaaaagcacatactgtactagtaccagtgaatcacttgttccaaatggcgctaaaacaacaatgatggcagtaccctctgtgcaacccgaaaaggcaaaaacacaaattgtggtaatcatataaacgtatttcgcagtagcaatgaactttggaaaacaatggattcaatcaagcaaacggacgagatcacgagcatggagcagctaggatgccctaatggatgcagacaggcactagaattaaacagaaaagcgtcaaatttcggccttgcaaggtacccaaaaaaaaaacaagaattcccaatatgtcagatcgctggaagcgcaatggcgtgctcatagcccaaaatctatatttgtacctcctctcggcggtttgacgtctgtctgtttgaacacaaagaagagatgaaacagttatacctctggggccgatgccgtcggaagccatggccgccggtccgaagtgccaaaaccaaccgacctgcgaatcaggggcgggcccagtgaaaaatggtcagatccgaatacaaatactagatttggggagttcggggtgtttgaattctcgcagaaggagcagaagggacggcatacctggaatatgctgtcgccggcgaagcggcctgatcgaatggcggcgccggcgcggcgctagggaaagaaaggcagagaaagacagtgtgtgcgcggggggcgctggggacaggttgaagcggaggaagaaaagagcaagtagggaacgcaacacccaacagccaaatcacccgaatgtaatttttcctaaatctataatttattttattttttaatctatacaatatatagatatataataaaattaataaatcataaaaattaaagctgaatcagagaaagtactaaataaaataggctttatgttaggcaaaaaaaaagtaaaaatagaacaattcaattcactatatgccactgtaattttgtgtaataccttattcatcgtacctcgtatgttactcgaattcaatatctcactcttacatgtcgtggccaaatgttaaatgtaaaatgttgtatgtcttagtcccttactatgacatgaaagagtaaaaaattgtattcgggtgacgtaaaaaggattagaacatttatgataacaaataagatactagacgagtgacatacatgatataattttatctctaaacctaatgaaactaataaaaaatgtcaattgatatcgtttgcgtttgctaatcacctcgaacaatcatcctcgcgggcatgtggttaaggctagaaaaaaaacttgaggctcacgagtcagatcaagttcggagcgtctgcgagcgagctagttgtaccaaattaatcaatatgtagaataatgatagatattagataatttatagatagtcggcttatttcttagcctttgatgataaatataagataattcataatggtgaataatatttttatattttatgtttatatattaataatttactatataatgaaataatatatatcggggtgtagctcgcgagccgacttcgagctgagccgagcctaactctctagctcgtgaaatggacgagccgagtcaagctcggctcgactcattttctacttgtggtcgaccaggtctaggtagtcatgaaccgcaaccaatctgtcagttttatcgattgttttagatcatgttaggcgagtgccggcgcttggctctactgcccgcccacccatgtggcacaaccaaatggtcagtatcacccgacatggtgccagcactaatagcctcgcttgtggttgtcgaggctactgatcggccgccagggttactattgaccgtgttgggaccgcgtcggtcgatactgactggttggtactgaacagctattgcggccatgtcgataacgatcgcctcttgccatgtggcaggttctaattgcttcgctttattttgattttttttcaaaaataaaaaaactagaacttggtctataaatagaggagtgtttgatctcattcacacaacccacacttcaaatttctctaccaccccttataatcctcttacactcgtttcaatcaaatcaagcattgttgtgatgttttcgttcagcttggacatcaatatgactgaaaagagttattcaagttattacaacaaaatataatgcaacaggcgtcagagcttggatccgagtctcctaggtcgatgaggtggccaaggcaacatcagagatacattgactgcgactatgtagttgcatacgaccggttaatgcaagaccatttcaacgacctgtgtgtctacccactgctctacttttgtcaaagttaccgcatctagagaagtctcttccttcatatcttagagagattgggtgagcacttcccatacttcactttttgaaccgatgcattcaaccgcagtgtttcctcccccaccagaagtgcacaattggcctaagcatgcttgcgtactgtagcattgctgactccatcgatgagtacatcaaaatgaggaaagttccacctcagagtgccttggactattctgtgtgaaagggtccctagttaagttggttaggtcgtctgagtagcactcctcaggtcctaagtttgaatcccggtgggagcgaattttaggctgaggttaacaaggtcactcactagtttccctagttgtgtgcacatgagatgggctgacctatggggcggatcctcgtgtaagggctagtagggctcaaagcacgagtaaagatctggcctatagggggcggactctcatgttgcatggggggaggggtacatctttcgtgacctttctcgatcagggctccgattaagcttcttcttaccgtgggggcagtatttcccctacgagtggagtttttggtctattctgtagaggtggtattgcatgtttcagggcggagtacaattatcatgccattgtcaatgacttaggcttatcttagctaaggaggtggaaaggggattttctattatgatattgagtatagattgcatgcattggaagtggaggaagaagacattttacaagggggatattggttctccatccatcatgctcgagacagttgcctcgtatgacttgtggatctgacatatttttatgaatctattaaaatgctaaaacggttagtattttaggacggagggaattattttttggaatatttttgtagcaacctaaacatagttcatctatgcttagtttggggggtgggatggttaggcctagaagctactgttgaattaatgagggcctaacccaaattaatattcaataatagtcaatgctaaaggcccactttaatgctacggtgtactagtactttagtaccataccggaagtacaagggacaattcaatcaacttaaataggcggatctttggtgcatctagtgagaagttgagaaaatgatgaaggactgccacacgcgcgcgccgccgggccgtggccgtggtagatcggaccttggtccgaatattccttcctaacggttgcacattttgcctaaagtgatgaccgtccattactgttgtacgttattggtcgtttcctatgttatggatagtaacgaacgagttataatgcttgtcagctattaacggacgtcactaatggcgtccgtttctggctggctgtaatgatagctctgatggtgaccgttactatccgttcgcctccctctgctcgtttatatatacaaaggaggtgaggctgcttctggttacgagagaacacacgtacaattcttagacgcgttgcgtacagcccatccctggttgaacctctctaaaccccggttgaacttttcctggaccccagttgaacctctctggaccccggttgaacttgccttggaccccggttgaacctgcctggaccccggttgaacttgactggaccccagttgaagttgaagttcaactggagttgagaaagctcgacacagctgaagtttagctcagctgaaaagctcaactgcagctgaagaagctcaactcagctgaagtttagttcagctgaaaagctcagctgcttttcaacaaaaacactctaggtttctcaaacctaaccatagtcaaccatagaattttaaagagatttttgattttcaaaaaatagcttttgaatatagaggcttgagctttggcaaacaccaaccttatttttggatccccttggtagtacgatgaatcctatactcaatttaagtaaaatataattaagtaaactccttgagtaattggtgtctcatgtgtgatttctccatggcgtt

SEQ ID NO: 50 - DNA, 3571 bp, Zea mays
  misc_feature (1933)..(1933): n is a, c, g, or t
ggagggggagacggtgaggcgcggccatggggggcgccaaggcggaggacaaaccggccgccgctgcagaagattggtgctaccaatttggaaacaaggttcgatttcttcaccatttgcactcctctgcaagactgggacacgtttccgggtttcgttctgcctgggcggcgacaaatctcatggcaaattgcctttggggggctcattccctgggttcacactccaaatccttccttgcgaccttctctcagccgtcgcgctttccgtggcaagccttttggaaccctgatctgaagtgtcactcagatcaatgcagtcgcattgattctattcgtttcctgtttccgtttcccccttttaacgtgtctgctagttccaagtcccgagcgttttccgttctctgtttcagaattgaagcttgttaagttctgtttttttttacaatccttcgtttttgtcccagtcctttctattcctggagaagttaggaatctgttgttctcctgttccatttctcggtgcagtattagttgcagaacaggaatccacttgatttgtcagtttaattatgcttgtgtcacctcagatgtgtcatattgatgatgactgcatttttttttcagctgtaatatgcgtgttggcttgcatttgtttctctctttattagtactaccagcattttcggtcagtattttttgtcttccttgctgaagaatgagaaggaaagctgtcatactcctcgtcgggatagcttcatttattatggcagctgggcgacagaatatatgggaatgtacttgaacttcacaaaaaagggccttttcatcccttgccgtgtcttccatgttggtaaaaaggctagtagctgaattgaatagtacgtgctcattttaactaccctgaggactagatagatcttgaagttttatttgtttatttctttttacttctgcttatatagatgtagccaaatatatgcttcttcagctcacgttgaacattaatgtttgtgttgtttgctgaaaggttttttactgtagcagaaggttacaaaataacagatcttacctcaaaaaagggctgcaatgcatatatactggcactgaaccgcgtatgcgcagtgcaacctgctgattggttttgtactggtcggatctgtttgcaggatgcatttgacttgaagcccccgaaaaaatcaccgatcgcgttgagaacggttgtctttgctatgactatgttatgcgggatatctatttgctcaatgtgcatgaagcaactagggagtgatggctggtcaagagttgtcaagattgaagttgtggaacaaccatgtaataagtccattgctcctctttcggaggctcaatttgtgcgctatcctcaaccgataacttacagcaggtgagatttgcactgtggtaagattgagcaatctcgtttgtttaatgcctaatatataatttttaatttctagggaggaatgcaagtgcaatgctgtccggtcctttgcaattatatcatcgcagcgatctggaagtggctggtttgaaacacttcttaacagccacatgaatgttagctccaatggtgaaattttctctagaaaagaaaggaggagtaacatttcctctatagtagataccctggataaagtgtacaatttggactggaatagtagtgcttccaagaatgagtgcactgcagctattggcttcaagtggatgctgaatcaggtgcggactaaaacatgcagtatagataatttatttggatgatcctttttcatttattgttccatttagttccagtatgtttcaattattactatctgtagtctcctaaacggcctacatgttctcaactgtagatgctagatgttattgcatattgcgccaaactttcctcaagaccatggaactttttttttttntttttttttttggaaaccactttagggcttgttcgttttagtgccaatccatatggattggatgggtttaaatacataagaagtcaaaatccttcttaaaatttttcaatctcttccaatccatgtgggtgggatgcgattccaatccatgtgggatgcgaataaccgaacaaggccttataggactgtcgaatagctagtttagttttctgacttgctgtcagatcctgcattttagacaatttctctctctcgaacatgcatgagaactgcaaatgcatatggagtaatatttgatagattctgtagtgtgtccagtagactgattataatctacatgtcaagcatgtttgtttcagggcttcatctaatttgtgcgagaacaaacttttttcctggtagacagattgcctaaccaaaccatgaatattggccaaacagagagttagagactggaaacaaaacaggcactctagctagggagtggaaacaaaggagcatttcttctgaacggggttggggttggggtgtatgttttcagggcctcgtggcaaaccatgcggacgtagtcgactacttcaaccgaagaggagtctctgcaatatttcttttcagaaggaacctgctccgtcagttggtatcacaagtagcgaacaatcacgacaggttacttaagcaactaaacggaacgcacaaggcccatgtccacacgaagcgtgaggttagtaatgctagctaagaaacgtgttcgcggctaatgtctcactctcacagcaagtctctgagctgagctgatctctgtctgtgtttgacgtgtcgttcgttctcgctccacaggcccatatactggcaagatacaggcccaggctcaacacgacgtcactgatatggcagctgaaacgagctgacgagtacactcgcgacgctcttgagaacctaaacaacacccggcacatgagcgtctactacgaggacgtcgtccgcaacagaacagtgcgttctcgctgatgccctttgtctgttcccttccgttggttgtatcgcttaccatcgctgctgcactgcagaagctcttggatgtcctggatttcctcggagtgccgaggaggaagctggtgagccggcacgtgaagatacacacgaagccgctgtcggagcagatcgagaactgggacgaggtctacagcgccctcaacggtacccagtacgagggcttcctgaatgccgctgactatctagtataacatcacgtttctggatgtagatagtgtgcgtgtgattctttcgtttcttgtttgtttctggcagaaattttgatgcggggtaggcgccttttgccgtgcatggttgcattctcggtaacctgatgctcctgtaactaaccctccagcttctctggtctttgtatttgccttgggtgtttgctgatgttctttcaaactatttgaaatcgggctgtcggagttccagatcacgggcggcaggataggtgatgtgacctagataaatgtacgagacacatgacaaatctatactacttattaaaagtgtaatagcagtctgccgttctgccatcctgcaacctcaaccgtccattccattgttctgcaatttcaaccgttcgatcccacccaccag

SEQ ID NO: 51 - DNA, 1896 bp, Zea mays
ccaaggcggaggacaaaccggccgccgctgcagaagattggtgctaccaatttggaaacaaggttcgatttcttcaccatttgcactcctctgcaagactgggacacgtttccgggtttcgttctgcctgggcggcgacaaatctcatggcaaattgcctttggggggctcattccctgggttcacactccaaatccttccttgcgaccttctctcagccgtcgcgctttccgtggcaagccttttggaaccctgatctgaagtgtcactcagatcaatgcagtcgcattgattctattcgtttcctgtttccgtttcccccttttaacgtgtctgctagttccaagtcccgagcgttttccgttctctgtttcagaattgaagcttgttaagttctgtttttttttacaatccttcgtttttgtcccagtcctttctattcctggagaagttaggaatctgttgttctcctgttccatttctcggtgcagtattagttgcagaacaggaatccacttgatttgtcagtttaattatgcttgtgtcacctcagatgtgtcatattgatgatgactgcatttttttttcagctgtaatatgcgtgttggcttgcatttgtttctctctttattagtactaccagcattttcggtcagtattttttgtcttccttgctgaagaatgagaaggaaagctgtcatactcctcgtcgggatagcttcatttattatggcagctgggcgacagaatatatgggaatgtacttgaacttcacaaaaaagggccttttcatcccttgccgtgtcttccatgttggtaaaaaggctagtagctgaattgaatagtacgtgctcattttaactaccctgaggactagatagatcttgaagttttatttgtttatttctttttacttctgcttatatagatgtagccaaatatatgcttcttcagctcacgttgaacattaatgtttgtgttgtttgctgaaaggttttttactgtagcagaaggttacaaaataacagatcttacctcaaaaaagggctgcaatgcatatatactggcactgaaccgcgtatgcgcagtgcaacctgctgattggttttgtactggtcggatctgtttgcaggatgcatttgacttgaagcccccgaaaaaatcaccgatcgcgttgagaacggttgtctttgctatgactatgttatgcgggatatctatttgctcaatgtgcatgaagcaactagggagtgatggctggtcaagagttgtcaagattgaagttgtggaacaaccatgtaataagtccattgctcctctttcggaggctcaatttgtgcgctatcctcaaccgataacttacagcaggtgagatttgcactgtggtaagattgagcaatctcgtttgtttaatgcctaatatataatttttaatttctagggaggaatgcaagtgcaatgctgtccggtcctttgcaattatatcatcgcagcgatctggaagtggctggtttgaaacacttcttaacagccacatgaatgttagctccaatggtgaaattttctctagaaaagaaaggaggagtaacatttcctctatagtagataccctggataaagtgtacaatttggactggaatagtagtgcttccaagaatgagtgcactgcagctattggcttcaagtggatgctgaatcaggtgcggactaaaacatgcagtatagataatttatttggatgatcctttttcatttattgttccatttagttccagtatgtttcaattattactatctgtagtctcctaaacggcctacatgttctcaactgtagatgctagatgttattgcatattgcgccaaactttcctcaagaccatggaacttttttttttt

SEQ ID NO: 52 - DNA, 1371 bp, Zea mays
agttcatcactaatcacacttattgtgccctcgacgagtatctatagctagctcattaatcgattcgggggtgtgttgtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctggaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatgcagaactgcccgcgcatctttcctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatat

SEQ ID NO: 53 - DNA, 1458 bp, Zea mays
agttcatcactaatcacacttattgtgccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctggaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaactacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggtaagcgagacgctgaccaacgtcatcatccctgccttcgacatcaggctgctgcagcctatcatcttctctacctacgacgccaagagcacgcctctgaagaacgcgctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaacccgtcgaactgccgcaggttcctggtgctgtccatcgggacggggtcgacgtccgagcagggcctctacacggcgcggcagtgctcccggtggggcatctgccggtggctccgcaacaacggcatggcccccatcatcgacatcttcatggcggccagctcggacctggtggacatccacgtcgccgcgatgttccagtcgctccacagcgacggcgactacctacgcatccaggacaactcgctccgtggcgccgcggcaaccgtggacgcggcgacgccggagaacatgcggacgctcgtcgggatcggggagcggatgctggcacagcgggtgtccagggtcaacgtggagacagggagcgaggtacgaaccggtgaccggagaaggaagcaatgccgatgccctcggtgggctcgctaggcagctctccgaggagaggagaacaaggctcgcgcgccgcgtctctgccatcaaccccagaagctctagatgtgcgccctacgatatctaagacaagtggctttactgtcaatcacatgcttgtaaataagtagactttattttaataaaatataaatatatatatat

SEQ ID NO: 54 - protein, 401 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMQNCPRIFPQKSRLAAAMSALRKPKYNGKCMRSLIRSILGETRAKSTPLKNALLSDVCIGTSAAPTYLPAHYFQTEDANGKEREYNLIDGGVAANNPTMVAMTQITKKMLASKDKAEELYPVKPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGRYEPVTGEGSNADALGGLARQLSEERRTRLARRVSAINPRGSRCASYDI

SEQ ID NO: 55 - protein, 428 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMQNCPRIFPQKSRLAAAMSALRKPKYNGKCMRSLIRSILGETRVSETLTNVIIPAFDIRLLQPIIFSTYDAKSTPLKNALLSDVCIGTSAAPTYLPAHYFQTEDANGKEREYNLIDGGVAANNPTMVAMTQITKKMLASKDKAEELYPVNPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGRYEPVTGEGSNADALGGLARQLSEERRTRLARRVSAINPRGSRCASYDI

SEQ ID NO: 56 - protein, 372 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINYFYMQNCPRIFPQKSRLAAAMSALRKPKYNGKCMRSLIRSILGETRAKSTPLKNALLSDVCIGTSAAPTYLPAHYFQTEDANGKEREYNLIDGGVAANNPTMVAMTQITKKMLASKDKAEELYPVNPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGSEVRTGDRRRKQCRCPRWAR

SEQ ID NO: 57 - protein, 399 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINYFYMQNCPRIFPQKSRLAAAMSALRKPKYNGKCMRSLIRSILGETRVSETLTNVIIPAFDIRLLQPIIFSTYDAKSTPLKNALLSDVCIGTSAAPTYLPAHYFQTEDANGKEREYNLIDGGVAANNPTMVAMTQITKKMLASKDKAEELYPVNPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGSEVRTGDRRRKQCRCPRWAR

SEQ ID NO: 58 - DNA, 2088 bp, Zea mays
tatttgtactcattccatgtctcataaactttgggcaccatccatccaacacatccaatctaaacacaccaaacgatggggaatggaaagagcagtattcgattcaacaatggcaaacaaatatcactgaattagaccaagaataaacctaattagacaacgacctcccaaccatcattcgtcaggctgtaaagaagataaagctgccttggggcatggatcaagcagaacaccagagatgaatccaaacacacagaaaatcacgcgcgctgtctacaatgacaacaagccccacatttcattgcagtacactgggctacaaaggcacgtacaacaaagagctagggaaacattgcggagggcacgagagagcagctaacttgacaatatagcagactgagcttgcactgttagcaggcgaggaagggaatcatggggacggagaatggggtccatgcccgcgaaggagaaggcggacgccgccacggtggcaccggcgcacgcgcacacagggaacccgcacaggcagccaaggatgctgcctcgccattgcgccggtcgtctctgccacgctcctctctctctcccgctgcatcgccgtggatggggcaagcagagagcagggactgcgacgatctgggcggaggactcgccttggagagcgcggacgcagacgggattctagggagagagcgaagacggggcgcgcgcggcgctcgcgcggcgtggtggcggcgagattagcgggggtggggggagggcggagccgtggtgagggtgtggacgccctccttaccctcttaagtagtagtagagatataatccgttccaaaatatccatccgttcaatttatatttcgtttgatctttttaccctaaatttgattgactcatcttattaaaaaagttcataactattattaatctttattgagatatcatttagcatataatatactttaagtgtggttttagattttttttaaaaaaaaaaattcgcaaaaattaaatgaaacgacccaatcaaacttgaaaagtaaaactaattataaatttgaacggaaggagtaagaggatgtttgaatgtactagagctaatagttggttgctttaaaatttgctagtagaattagctagctaataaatatctagataactattagctaatttgctaaaacagctaatagttgaactattagctagattgtttggatgtattcggctaattttaatggctaactattagctatagtacaatattcaaacacctcctaattaaaatggacaaatatctcttcttttggtcccttgcgttagatttttcatatctccttatttagtataaaagaatcatcaaaaagtggacaacccctagtggaacaccattttagtagtggttgcatgaaacctttcgcgcaccagtttctatgtgtcactctaaaaatgggacagcatgtacgtagtgcctatatatatacaagtcatctatcgttgcctcctcagttcatcactaatcacacttattgtgccctcgacgagtatctatagctagctcattaatcgattcgggggtgtgttgtcgaaggcggcattggcgagctactcgtcgcggcgtccaagcaatacctgtagcacgaaggcgatcgccgggagcgtggtcggcgagcccgtcgtgctggggcagagggtgacggtgctgacggtggacggcggcggcgtccggggtctcatcccgggaaccatcctcgccttcctggaggccaggctgcaggagctggacgcaccggaggcgaggctggcggactacttcgactacatcgccggaaccagcaccggcggtctcatcaccgccttgctgaccgcgcccggcaaggacaagcggcctctctaggctgccaaggacatcaaccacttttacatccataactgcccgcgcatctttcctcagaagtgagtccgatgctgccgccattgttcttgcatccatccagcatcgtacgtacgtcctctatacatctgcggatcatcatgtgcgcatgtttgtggcatgcatgcatgcatgtgagcaggagcaggcttgcgaaaacc

SEQ ID NO: 59 - DNA, 996 bp, Zea mays
gacaagtggctttactgtcagtcacatgcttgtaaataagtagactttattttaataaaacataaaaatatatatatgttcttgaatataaaattgataaccaaattaaaattcgaaccatcacttatacataattttactttattttttataaaacgtgaacgggaaggactaccgtgaatgactatagaaccaatcatactagtataaaatatatgatgacactacgggagagacaaactttgtctggcgctaaatattttgccgagtgtgaattcacgggcactaggcaaagatcttctttgccgagtgttacgctgggcaaagtaagacactaggtaaatcagtcatttgccgagtgtccgccactaggcaaagcaaaacactggcaaatcaaaagtttacctagtgccagacactaggcaaaaaaaaaacgctcggcaaatcggaagtttccctagtgccagacactagacaaagaaaaacacttgataaactagcgtcgtcagctaacaccatccaccaaccgttaacgttgccgagtatctgacttcgacactcggcaaagaaggtctctttgcctagtgtcggtctggaacactaggcaaagaggcactttacctagtgtcgtattttgacactcagtaaaataattttttttctttctgcttccaaactttttatgatgtgttcctatagcacctagaactacatgtcaagttttggtaaaatttttgaagtttttgctatatttacttaatttattttatttaattgaatttcttttgataattcaaatttgaactcggcaaggtaagaagcgagggtagcctggaaacacactttgcctagtgttacactcggtacaggagcctcccctgcctagtgctgcactcgacaaaagattcgcctttgcctagcgctgcactcggcacaggagtcgcctttgcctagtgctgcactaggcaaagcctccgttaccgtgccttccatcgt

SEQ ID NO: 60 - DNA, 1089 bp, Artificial Sequence
  Synthetic
ttgcgatggcgcagatcaccaaaaagatgcttgccaacaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcgtcgactcgggagcatgccctttgtgcttatgcctccgttctgccttctgacgaatttggtactggaagcagatgagttttggttcactatcattctgaatttacacctgcgcttgctgtcagactaggcaaccaagtgacttttgtgactttgatcatgttcagtgtgtttccaagtcctaatcaatcaaaaagaaaaacagtttgttaacgattgtttgccatgtctatataataaagttgcttttatagtagcttagaattcaatcggccaactttatctcgtacgctgacagtaaaggtacatttaaaaggtgacaatggatagtctaatacttgaactgacaatagagacacattacatgtcagttgattaagtttgtaacagaaaaataaacaatactacataattgcaaagtttctttgatgtctttctttcaagaaacacaaatatatcaatgctacagtattgctgatgaatttatccatgttgagatgtttttctggtttctgatctgatcagtctcaattggtgtgctgtttcattttcatttgctgatgatcgtccgagtagttaattcttactaatatttagataatttggcatacaagcgaatcacgtagaacatgatacttttgaatgaatttatcaaagttttatcacttggtgagttgtttcatggttttcctactgatgtctcttcttcagatttctcgaggcggagccaccggcagataccccaccgggagcactgccgcgccgtgtagaggccctgctcggacgtcgaccccgtcccgatggacagcaccaggaacctgcggcagttcgacggcttcactgggtacagctcctcggccttgtccttgctggcaagcatctttttggtgatctgcgtcatcgcaa

SEQ ID NO: 61 - DNA, 915 bp, Artificial Sequence
  Synthetic
gaacaggcttgcggccgccgtgtccgcgctgaggaagccaaagtacaacggcaagtgcatgcgcagcctgattaggagcatcctcggcgagacgaggggtcgactcgggagcatgccctttgtgcttatgcctccgttctgccttctgacgaatttggtactggaagcagatgagttttggttcactatcattctgaatttacacctgcgcttgctgtcagactaggcaaccaagtgacttttgtgactttgatcatgttcagtgtgtttccaagtcctaatcaatcaaaaagaaaaacagtttgttaacgattgtttgccatgtctatataataaagttgcttttatagtagcttagaattcaatcggccaactttatctcgtacgctgacagtaaaggtacatttaaaaggtgacaatggatagtctaatacttgaactgacaatagagacacattacatgtcagttgattaagtttgtaacagaaaaataaacaatactacataattgcaaagtttctttgatgtctttctttcaagaaacacaaatatatcaatgctacagtattgctgatgaatttatccatgttgagatgtttttctggtttctgatctgatcagtctcaattggtgtgctgtttcattttcatttgctgatgatcgtccgagtagttaattcttactaatatttagataatttggcatacaagcgaatcacgtagaacatgatacttttgaatgaatttatcaaagttttatcacttggtgagttgtttcatggttttcctactgatgtctcttcttcagatttctcgagccctcgtctcgccgaggatgctcctaatcaggctgcgcatgcacttgccgttgtactttggcttcctcagcgcggacatggcggccgcaagcctgctc

SEQ ID NO: 62 - DNA, 1452 bp, Zea mays
atatatatttttatgttttattaaaataaagtctacttatttacaagcatgtgactgacagtaaagccacttgtcttagatatcgtacgacgcacatctagagcctcttgggttgatggcagagacgcggcgcgcgagccttgttctcctctcctcggagagctgcctagcgagcccaccgagggcatcggcattgcttccttcgccagtcaccggttcgtacctccctgtctccacgttgaccctggacaccctctgtgccagcatccgctccccgatcccgacgagcgtccgcatgttctccggcgtcgccgcgtccacggtggccgcggcgccacggagcgagttgtcctggatgcgcaggtagtcgccgtcgctgtggagcgactggaacatcgcggcgacgtggatgtccaccaggtccgagctggccgccatgaagatgtcgatgatgggggccatgccgttgttgcggagccaccggcagataccccaccgggagcactgccgcgccgtgtagaggccctgctcggacgtcgaccccgtcccgatggacagcaccaggaacctgcggcagttcgacggcttcactgggtacagctcctcggccttgtccttgctggcaagcatctttttggtgatctgcgtcatcgcaaccatcgtcgggttgttggccgccacaccgccgtcgatgaggttgtattcgcgctccttgccgttggcgtcttcagtctggaagtagtgcgccgggaggtaggtcggcgcggcggacgtgccaatgcacacgtccgagagcagagcgttcttcagaggcgtgctcttggcgtcgtaggtagagaagatgataggctgcagcagcctgatgtcgaaggcagggatgatgacgttggtcagcgtctcgcttaccctcgtctcgccgaggatgctcctaatcaggctgcgcatgcacttgccgttgtactttggcttcctcagcgcggacatggcggccgcaagcctgctcttctgaggaaagatgcgcgggcagttctgcatgtaaaagtggttgatgtccttggcagcgtagagaggccgcttgtccttgccgggcgcggtgagcatggcggtgatgagaccgccggtgctggttccggcgatgtagtcgaagtagtccgccagcctcgcctccggtccgtccagctcctgcagcctggcctccaggaaggcgaggatggttcccgggatgagaccccggacgccgccgccgtccaccgtcagcaccgtcaccctctgccccagcacgacgggctcgccgaccacgctcccggccatcgccttcgtgctacaggtattgcatggacgccgcgacgagtagctcgccattgccgccttcgacaacacacccccgaatcgattaatgagctagctatagatactcgtcgagggcacaataagtgtgattagtgatgaact

SEQ ID NO: 63 - DNA, 1382 bp, Zea mays
tcagaatatatatatatttatattttattaaaataaagtctacttatttacaagcatgtgattgacagtaaagccacttgtcttagatatcgtagggcgcacatctagagcttctggggttgatggcagagacgcggcgcgcgagccttgttctcctctcctcggagagctgcctagcgagcccaccgagggcatcggcattgcttccttctccggtcaccggttcgtacctcgctccctgtctccacgttgaccctggacacccgctgtgccagcatccgctccccgatcccgacgagcgtccgcatgttctccggcgtcgccgcgtccacggttgccgcggcgccacggagcgagttgtcctggatgcgtaggtagtcgccgtcgctgtggagcgactggaacatcgcggcgacgtggatgtccaccaggtccgagctggccgccatgaagatgtcgatgatgggggccatgccgttgttgcggagccaccggcagatgccccaccgggagcactgccgcgccgtgtagaggccctgctcggacgtcgaccccgtcccgatggacagcaccaggaacctgcggcagttcgacgggttcactgggtacagctcctcggccttgtccttgctggcaagcatctttttggtgatctgcgtcatcgcaaccatcgtcgggttgttggccgccacaccgccgtcgatgaggttgtattcgcgctccttgccgttggcgtcttcagtctggaagtagtgcgccgggaggtaggtcggcgcggcggacgtgccaatgcacacgtccgagagcagcgcgttcttcagaggcgtgctcttggccctcgtctcgccgaggatgctcctaatcaggctgcgcatgcacttgccgttgtactttggcttcctcagcgcggacatggcggccgcaagcctgctcttctgagggaagatgcgcgggcagttctccatgtaaaagtagttgatgtccttggcagcgtagagaggccgcttgtccttgccgggcgcggtgagcatggcggtgatgagaccgccggtgctggttccggcgatgtagtcgaagtagtccgccagcctcgcctccggtccgtccagctcctgcagcctggcctccaggaaggcgaggatggttcccgggatgagaccccggacgccgccgccgtccaccgtcagcaccgtcaccctctgccccagcacgacgggctcgccgaccacgctcccggccatcgccttcgtgctacaggtattgcatggacgccgcgacgagtagctcgccattgccgccttcgaccgcacaccccgattgatcgattaatgagctagctagatactcgtcgagggcacaataagtgtgattagtgatgaact

SEQ ID NO: 64 - DNA, 19 bp, Zea mays
tacgccgtgcgctaacata

SEQ ID NO: 65 - DNA, 20 bp, Zea mays
gtacctcgctccctgtctcc

SEQ ID NO: 66 - DNA, 18 bp, Zea mays
gtacgccgtgcgctaaca

SEQ ID NO: 67 - DNA, 20 bp, Zea mays
tcgtacctccctgtctccac

SEQ ID NO: 68 - DNA, 1371 bp, Zea mays
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggagaacaaggctcgcgcgccgcgtgtctgccatcaacccaagaggctctagatgtgcgtcgtacgatatctaagacaagtggctttactgtcagtcacatgcttgtaaataagtagactttattttaataaaacataaaaatatatat

SEQ ID NO: 69 - protein, 401 aa, Zea mays; identical to SEQ ID NO: 54

SEQ ID NO: 70 - DNA, 1375 bp, Zea mays
agttcatcactaatcacacttattgtgccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctggaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaactacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgcgctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaacccgtcgaactgccgcaggttcctggtgctgtccatcgggacggggtcgacgtccgagcagggcctctacacggcgcggcagtgctcccggtggggcatctgccggtggctccgcaacaacggcatggcccccatcatcgacatcttcatggcggccagctcggacctggtggacatccacgtcgccgcgatgttccagtcgctccacagcgacggcgactacctacgcatccaggacaactcgctccgtggcgccgcggcaaccgtggacgcggcgacgccggagaacatgcggacgctcgtcgggatcggggagcggatgctggcacagcgggtgtccagggtcaacgtggagacagggagcgaggtacgaaccggtgaccggagaaggaagcaatgccgatgccctcggtgggctcgctaggcagctctccgaggagaggagaacaaggctcgcgcgccgcgtctctgccatcaaccccagaagctctagatgtgcgccctacgatatctaagacaagtggctttactgtcaatcacatgcttgtaaataagtagactttattttaataaaatataaaaatatatat

SEQ ID NO: 71 - protein, 372 aa, Zea mays; identical to SEQ ID NO: 56

SEQ ID NO: 72 - DNA, 1358 bp, Artificial Sequence
  TALEN-induced MTL mutation in Event 39A individual ID 22808-3954 allele 1
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagaaccggtgactggcgaaggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatat

SEQ ID NO: 73 - DNA, 1366 bp, Artificial Sequence
  TALEN-induced MTL mutation in Event 23A individual ID 22808-3924 allele 1
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggagaaccggtgactggcgaaggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatat

SEQ ID NO: 74 - DNA, 1358 bp, Artificial Sequence; identical to SEQ ID NO: 72
  TALEN-induced MTL mutation in Event 81A

SEQ ID NO: 75 - DNA, 1343 bp, Artificial Sequence
  TALEN-induced MTL mutation in Event 39A individual ID 22808-3954 allele 2
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatat

SEQ ID NO: 76 - DNA, 1363 bp, Artificial Sequence
  TALEN-induced MTL mutation in Event 23A ID 22808-3924 allele 2
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacaggaaccggtgactggcgaaggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatat

SEQ ID NO: 77 - DNA, 1360 bp, Artificial Sequence
  TALEN-induced MTL mutation in Event 38A individual ID 22808-4108 allele 1
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacaaccggtgactggcgaaggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatat

SEQ ID NO: 78 - DNA, 1363 bp, Artificial Sequence; identical to SEQ ID NO: 76
  CRISPR-induced MTL mutation in Event 18A ID 22807-4016

SEQ ID NO: 79 - DNA, 1372 bp, Artificial Sequence
  CRISPR-induced MTL mutation in Event 27A individual ID 22807-4801 allele 1
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacaagggaggtacgaaccggtgactggcgaaggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatat

SEQ ID NO: 80 - DNA, 1372 bp, Artificial Sequence; identical to SEQ ID NO: 79
  CRISPR-induced mutation in Event 27A individual ID 22807-4081 allele 1

SEQ ID NO: 81 - DNA, 1373 bp, Artificial Sequence
  CRISPR-induced MTL mutation in Event 76A individual ID 22873-3999
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacaaagggaggtacgaaccggtgactggcgaaggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatat

SEQ ID NO: 82 - DNA, 1370 bp, Artificial Sequence
  CRISPR-induced mutation in Event 32A individual ID 22873-3991
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacgggaggtacgaaccggtgactggcgaaggaagcaatgccgatgccctcggtgggctcgctaggcagctctccgaggagaggagaacaaggctcgcgcgccgcgtgtctgccatcaacccaagaggctctagatgtgcgtcgtacgatatctaagacaagtggctttactgtcagtcacatgcttgtaaataagtagactttattttaataaaacataaaaatatatat

SEQ ID NO: 83 - DNA, 18 bp, Artificial Sequence
  nucleotide sequence encoding guide RNA
gtcaacgtggagacaggg

SEQ ID NO: 84 - DNA, 1823 bp, Oryza sativa
  5'UTR (1)..(78)
  exon (79)..(444): exon 1
  Intron (445)..(536): intron 1
  exon (537)..(717): exon 2
  Intron (718)..(803): intron 2
  exon (804)..(967): exon 3
  Intron (968)..(1074): intron 3
  exon (1075)..(1662): exon 4
  3'UTR (1663)..(1823)
acagtgactagtgacaaacgatcgatcgatccctccatccacaaaccctcctcgatctcatcttccttcgtctcgtcaatggcggcgagctactcgtgccggcggacatgcgaggcgtgcagcacgagggcgatggccgggtgcgtggtgggcgagccggcgtcggcgccggggcagcgggtgacgttgctggcgatcgacggcggcggcatcaggggcctcatcccgggcaccatcctcgccttcctcgaggccaggctgcaggagctggatggccccgacgcgcgcctcgccgattacttcgactgcatcgccgggaccagcaccggcggcctcatcaccgccatgctcgccgcgcccggcgaccacggccgcccgctcttcgccgccagcgacatcaaccgcttctacctcgacaacggcccactcatcttcccacaaaagtaactgatcacctcgaattcgatctcctctcttcgatctctgcattatttgatttgattggggattgtgggcggcgtggcgtggcgtccaggaggtgcggcatggcggcggccatggcggcgctgacgaggccgaggtacaacggcaagtacctgcaggggaagatcaggaagatgctgggcgagacgagggtgcgcgacacgctgacgaacgtcgtcatccccacgttcgacgtcaggctgctccagccaaccatcttctccacatacgacgtgcgtgcgttgattccatccgcattggcgttggaatcagctgattgtttgattgatcgaacaattgatcggttaaaattttgcaggcgaagagcatgccgctcaagaacgcgctcctctccgacatctgcatcagcacatccgcggcgccgacctacctccccgcgcactgcttccagaccaccgacgacgccaccggcaaggtccgcgagttcgacctcatcgacggcggcgtcgccgccaacaacccggtaactaatcaatcaagcaatccatcaaacgaagatccacatgtgcattcctgtggtacaaatgctgatcgatcgatggatggatcgattttcgcgagaacgtacagacgatggtggccatgacgcagatcaccaagaagataatggtgaaggacaaggaggagctgtacccggtaaagccgtcggactgcggtaagttcctggtgctgtccgtgggcaccgggtcgacgtcggaccaggggatgtacacggcgaggcagtgctcgcggtgggggatcgtccggtggctgcgcaacaaggggatggcgcccatcatcgacatcttcatggcggccagctccgacctcgtcgacatccacgccgccgtcatgttccagtcgctgcacagcgacggcgactacctccgcatccaggacaacacgctccacggcgacgccgccacggtggacgccgccaccagggacaacatgcgggcgctcgtcgggatcggcgagcggatgctggcgcagcgggtgtcgagggtcaacgtcgagaccggcaggtacgtcgaggtgcccggcgccggcagcaacgccgacgcgctgaggggcttcgccaggcagctctccgaggagaggagggcgaggctaggtcggcgaaacgcctgcggcggcggcggcgaaggagagcccagcggcgtggcgtgcaagcgttagtaactgtacacgcatcatgctgacgcgatcttttttatttttctttttttttttttacctttctagcggacatggggaataacaagacgtgacagtagtgcaatcggtttgtaacgtgcgtataccaacattgatccatttcttcatcacagtttcagttc

SEQ ID NO: 85 - DNA, 1299 bp, Oryza sativa
atggcggcgagctactcgtgccggcggacatgcgaggcgtgcagcacgagggcgatggccgggtgcgtggtgggcgagccggcgtcggcgccggggcagcgggtgacgttgctggcgatcgacggcggcggcatcaggggcctcatcccgggcaccatcctcgccttcctcgaggccaggctgcaggagctggatggccccgacgcgcgcctcgccgattacttcgactgcatcgccgggaccagcaccggcggcctcatcaccgccatgctcgccgcgcccggcgaccacggccgcccgctcttcgccgccagcgacatcaaccgcttctacctcgacaacggcccactcatcttcccacaaaagaggtgcggcatggcggcggccatggcggcgctgacgaggccgaggtacaacggcaagtacctgcaggggaagatcaggaagatgctgggcgagacgagggtgcgcgacacgctgacgaacgtcgtcatccccacgttcgacgtcaggctgctccagccaaccatcttctccacatacgacgcgaagagcatgccgctcaagaacgcgctcctctccgacatctgcatcagcacatccgcggcgccgacctacctccccgcgcactgcttccagaccaccgacgacgccaccggcaaggtccgcgagttcgacctcatcgacggcggcgtcgccgccaacaacccgacgatggtggccatgacgcagatcaccaagaagataatggtgaaggacaaggaggagctgtacccggtaaagccgtcggactgcggtaagttcctggtgctgtccgtgggcaccgggtcgacgtcggaccaggggatgtacacggcgaggcagtgctcgcggtgggggatcgtccggtggctgcgcaacaaggggatggcgcccatcatcgacatcttcatggcggccagctccgacctcgtcgacatccacgccgccgtcatgttccagtcgctgcacagcgacggcgactacctccgcatccaggacaacacgctccacggcgacgccgccacggtggacgccgccaccagggacaacatgcgggcgctcgtcgggatcggcgagcggatgctggcgcagcgggtgtcgagggtcaacgtcgagaccggcaggtacgtcgaggtgcccggcgccggcagcaacgccgacgcgctgaggggcttcgccaggcagctctccgaggagaggagggcgaggctaggtcggcgaaacgcctgcggcggcggcggcgaaggagagcccagcggcgtggcgtgcaagcgttag

SEQ ID NO: 86 - protein, 432 aa, Oryza sativa
MAASYSCRRTCEACSTRAMAGCVVGEPASAPGQRVTLLAIDGGGIRGLIPGTILAFLEARLQELDGPDARLADYFDCIAGTSTGGLITAMLAAPGDHGRPLFAASDINRFYLDNGPLIFPQKRCGMAAAMAALTRPRYNGKYLQGKIRKMLGETRVRDTLTNVVIPTFDVRLLQPTIFSTYDAKSMPLKNALLSDICISTSAAPTYLPAHCFQTTDDATGKVREFDLIDGGVAANNPTMVAMTQITKKIMVKDKEELYPVKPSDCGKFLVLSVGTGSTSDQGMYTARQCSRWGIVRWLRNKGMAPIIDIFMAASSDLVDIHAAVMFQSLHSDGDYLRIQDNTLHGDAATVDAATRDNMRALVGIGERMLAQRVSRVNVETGRYVEVPGAGSNADALRGFARQLSEERRARLGRRNACGGGGEGEPSGVACKR

SEQ ID NO: 87 - DNA, 1371 bp, Zea mays; identical to SEQ ID NO: 52

SEQ ID NO: 88 - DNA, 1375 bp, Zea mays; identical to SEQ ID NO: 70

SEQ ID NO: 89 - DNA, 1375 bp, Zea mays; identical to SEQ ID NO: 70

SEQ ID NO: 90 - protein, 401 aa, Zea mays; identical to SEQ ID NO: 54

SEQ ID NO: 91 - protein, 372 aa, Zea mays; identical to SEQ ID NO: 56

SEQ ID NO: 92 - protein, 372 aa, Zea mays; identical to SEQ ID NO: 56

SEQ ID NO: 93 - DNA, 15463 bp, Artificial Sequence
  Expression cassette of construct 22466
  promoter (214)..(2339)
  gene (2341)..(3018)
  terminator (3024)..(4036)
  enhancer (4044)..(4237): eFMV
  enhancer (4244)..(4536): e35S
  promoter (4544)..(8537): Ubi
  terminator (10009)..(11008): Ubi
  promoter (11028)..(12618): pPLA2
  exon (12619)..(12977): PLA2 exon1
  Intron (12978)..(13096): PLA2 intron1
  exon (13097)..(13193): PLA2 exon2
  Intron (13194)..(13388): PLA2 intron2
  exon (13389)..(13550): PLA2 exon3
  Intron (13551)..(13660): PLA2 intron3
  exon (13661)..(14248): PLA2 exon4
  terminator (14249)..(15244): tPLA2
cctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggacccgaaagtagcaaacaacaggttcatgtgcactataaaaagacaaaattctcgagtttcatcttttattccacataagccttatattttccattttcatatgatttttagtttaagtttgtgtcttaactttttcgttaatacgtaattctatgcattatggatgcgtgaagtatttttgtttaaaaaaatgaaatgtcaaaatacgttttgtgatctatttccatgttttcacctaacaggtggtttttactatatattctgccataactctagccttagatgtaaatcgaaaaaaaatgagagatgagctggagatagccttagatgaagcgtctgaaatataaaagaaagagtaatgttgaacgcagtaggtgtagcagctgtagttccatctctaggaaagggaactgcaatccgggctccgggcctcgcgcaatctggcctgtcgtgtagatgcagccctgtccatgacggcccaagcaacgcccgcggctctcgatccaccacggaacccactccgacacacactgacacacacatgctggatgtggatgtgctgtccaattattagtagcaattcggtaggcacaggcacgtactggccggtgttttagctgtaagtaccgaaccaatcacggttaagaaccgattaatccgtgcccagccgccgagtgcgttcgtacgtgcatcggatgcactgcatgaattgagagcatcatcatatcatacgcaggagtagtacgacgccgctgctgtcttgtccggctaatgctttgctcacagattagtccatcgcccacggtcggtgtggtgtggatcgctgatgccactgctttttgtttggtttttattcccctgataatcctccgcgtccctgaatgtatctatttattttcattccgaaatccctttcacgaaaaagaaaacgaataaaaagagagttacgaatacgcttccggcggcccacatcaccttccagcgaacatcgcgccgcgctgacgtgtcgcccatcgcggccgtccatatcgccatccgacgaccgtggaagctggcagcggccgctccgttccgtcgaaggggcaggtcagtcaggtcacccacacggccacacccgcgcgggggatacgcggtggaaaacccggcgaccacatcaaaacacgaggcgtctcccgcaggactggtcactcggcacgcaggcagaggcagcacagcagcagccagctccatccatcctctttcccctcctcgcttcgcttcctcggcggattcctcctccctcggccgtccccgtccccttcttcgccgcgccagctcgcccgagttggtacgcccatcctctgctgtactccccccgttcctgctgtgcgaaaccgagcacccaaaccctagcctaagctattcgcatcgcaaactctattgagcgacggatcgcgaaacgcgcgccgccgcattcggacgagacctcgtggcccgtaccttcctactctaccgtcgtcgccggagaccagctcaccggttagggtttcgggattaggggcttggggcttggattcccgggggactccatacccggtggccttagaaggggaagggggcccagcggtggtggtggttcgactgtcagcgagcgagacggcggggcaccgccgatcgggcgtcgctggacatttgattgagctgggcaggcgaaggcgtggagcttgctcttcgattgggattagaggagggcggaggtggtatggtgggcggctcggctggctcaatggagccgctggccggtggtggggcaggcgagatcacgctctctcatagagcgtaatgggttgcgtaacacactcctgtttgtatttcgatccgatctaataattaaagtttatttacgtggtgcacatgtagaattttcccatgcccactgctaacttggattggatttttgccaaaaaaacgggtgtgcacccaatcacttatagtgaaaccgttgtgtgtttgatgtgcttctaaccaagtacaaatccagtgaaaacacacctaccattcaacaatccacattttggttgcaattatcagcattctagaaaggtgcatgtgcccattgatacacttgctattggtgcaggcaaacccaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtaggagctcgcatcatgatcatgcatcatggactcggcctactactgtggatttgtatgccattatagacttggtgctgtgaaagactgcttgatgatttgcgggtttgttgctgtgtaaaaaaaggtcccttggctcccagaagaccatgaaggttcggatctatcatgtaattccttgttatctgccaattatgtatggactatggacatgtgttgcgctgttcaacttactactacaaataagtaatcgatatgttcccttcccatgtctcggtgacaattgtctggagaagcttaggggtcgtttgtttgggattatgtctggagaaacttattttaaactaagtgtgagttcaagttaagttagattatataatctaggcagattataattccaagcgaacaggtccttagtgtttttggaaaatcctaggtgttcttttggctacattgttgtgtgtgcagatcccttgttggtctgtaagcgtggggaagtaagaatcgtccgtttctactgaagacctgctcgagttaggcaccgaggatgccggtaaccaaacagagcaatagtgtctctgtgggcacagtggagtgtgaatctgtgtgatgcaaatccgtcatttgtttagcaaaatttccagcgttgcatgatgcagtttctttaacacggacttaagggaagggaaaaaaatgttgagccaggagatccttcaatgtgttagactgacgtgatagccaactaaaccacgacgcaatgttgtcgttaatgacaaaaaaactatttgttcctaaatccttggcgacattgcatggctgtctcatgagataatggtctcatctcttatttatctcttatttatagccggaagtggtagtgacccctgcttgattgctcgtatgccatctcaagttctcaaccgtgtcgagcagccattttcccatctcaagcgcatcatcgtttcgtttgacctcatctgctatcctgctcctagtgcaaatcacatgcgacagaaagtgtgcggacccagctgcttgtggggaccagacaaaaaaggaatggtgcagaattgttaggcgcacctaccaaaagcaactttgcctttattgcaaagataaagcagattcctctagtacaagtggggaacaaaataacgtggaaaagagctgtcctgacagcccactcactattgcgtttgacgaacgcagtgacgaccacaaaactcgagacttttcaacaaagggtattatccggaaacctcctcggattccattgcccagctatctgtcactttattgtgaagatagtggaaaaggaaggtggctcctacaaatgccatcattgcgataaaggaaaggctatcgttgaagatgcctctgccgacagtggtcccaaagatggacccccacccacgaggagcatcgtggaaaaagaagacgttccaaccacgtcttcaaagcaagtggattgatgtgatatctccactgacgtaagggttgacgaacaatcccactatccttcaagctttggaaaaccaaaacaacgaataagcaaactgcaggaaaagtatgcagtggaaaccaacccagattcggacgataggaaagtatcaagtgaatgatttgccaggaaaaggagaggggtaaaaaggggcgaagatttagaagatctaaagcacaagaaccagagattagattgaacaatagggaacttggagcatcctttttttcttcagggaaaaactgaaaatccaaaccatgttgagcaaaaccgagtgggattggaaaccaaaaaacccgagataaagaaactcgagaaaaagcatgaaatcgaaaccaacttcagtaaaacaaaaggaggacagaaaagaaagtcggaagctataaagaatacattaacattcagtgaaacagcatgctgtcttcttctttttttatgcacaacagagcatacatatataccttcccaggctgaggacttggcggaggagagccgcggataggttggcggtgcagacggtctggacgggcccgaagacggagacgaacagcgggcccttcctgcccaggcaccacgcttggaacgccaagcacgcgccaaccgcggccccgccgaggacgacgatccccgcgacaagcgtggcgtcgatcctgggcgaccccaagccgaggaacctcccttccaggacgagccgtaggacggcggtgagagaggcacccgtcgcggaggtggcgcagcacaaggtgagcagcgcggggaaggcggcgagcgtggcggcctgcaggacggtgacgagcgcgaagacggtgacgccggcgacgaggcagcagcagccgaggatccagtcgtaggaggaagccggaccaaaccgggcaatgcaacctgcagatgcactagacggaggtaacgaggaggaggagaaaacagagcaagagcaggcggagagaagatagagcaaaacacgagtgaggcacagcgtaagcactcggtagaagtctccagaggcgaggtgcgcacaggagaacagatgagtaaagtcagccaaggatccacgatccaacggctacgaatttttggagtgacgtggataggctcaaaggcgccatttccatccggctttatagtattttaaaaaaattcattttcctccctctagtgtgtgcggaggcgtgagcccgtttaacggcgttgagaagtctaacggacaccaaccacaaccaggaaccagcgccggccgcgccgccgagtgaagcagactgcatacggcacggcgcggcatctctctggctgcctctcgagagttccgcccccaccttcccgcggtagcgtggtggtttcgctttccgctgtcggcatccggaagttgcgtggcagagtggacggagacgaggccgggtcctccagctcctctcaaacgtcacggcaccggcatccggcagccagcgcggtccttcccaaccactcgttcccaacccatcccccttcctcgcccgccgtcataaatagccagccccatccccagcttctttccccaacctcatcttctctccttttgctctgaacgcacacaccgcccggtctccgatctccgatccccgatcccctcgtcgatcctaggtacggcgaccatcctaccccccccccccccccctctctctctgccttctctagatcggcgatccgatccatgcttacttggttagggcctgctaactatgttcatgtttgcgttagatccgtgcatggacgcgatctgtacacaccagacgcgttctgattgctagctaactcgccagtacctgggaatcctgggatggctgtagccggccccgcacgcagacgggaccgatttcatgattctctatttttttctttgtttcgttgcctagggtttcgttcgatcgatccgcgttattctttatttccatatattctggtacgatgttgatacggttcgaccgtgctgcttacgttctgtgcgcttgtttgccgggtcatttttaccttgccttttttgtatggtttggttgtggcgatgtggtctggtcgggctgtcgttctagatcggagtagagtgctgtttcaaactgtctagcggatctattagatttggatctgcatgtgtgacatatatcttcgtagttaagatgatgcatctgtatgtgtgacatgcggatctattagatttggatctgtatgtgtgacatatatcttcgtagttgagatgatgcatctgtatgtgtgacatatatcttcgtagttaagattatgcatggaaatatcaatcctttagataaggacgggtatacttgttgctgtgggttttactggtacttcgatagatgcatatacatgatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctatatattctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcagatccagatcttcgtaaaccatggctctggtggctaggccagtgctgtctgctagagtggctgcttctaggccaagggtggccgctagaaaggctgtgagggtgagcgctgccagtcacggcgctagctctaggccagccaccgctaggaagtccagcggcctgagcggcaccgtgcgcatcccaggcgacaagagcatcagtcaccgcagcttcatgttcggcggcctggccagcggcgagactaggatcaccggcctgctcgagggcgaggacgtgatcaacaccggcaaggccatgcaggctatgggcgctcgcatccgcaaggagggcgacacctggatcatcgacggcgtgggtaatggcggcctgctggccccagaggccccactggacttcggcaacgccgccaccggctgcaggctgactatgggcctggtgggcgtgtacgacttcgacagcacctttatcggcgacgccagcctgaccaagaggccgatgggcagggtgctgaacccgctgcgcgagatgggcgtgcaggtcaagagcgaggacggcgacaggctgccggtgaccctgaggggcccaaagaccccgaccccgatcacctaccgcgtgccaatggccagcgcccaggtgaagtcagccgtgctgctggccggcctgaacaccccaggcatcaccaccgtgatcgagccgatcatgacccgcgatcacaccgagaagatgctgcagggcttcggcgccaacctgaccgtcgagactgacgctgacggcgtgaggaccatcaggctcgagggcaggggcaagctgaccggccaggtgatcgacgtgccgggcgacccaagcagcaccgccttcccactggtggccgccctgctggtgccaggctctgacgtgaccatcctgaacgtgctgatgaacccgagccgcaccggcctgatcctgaccctgcaggagatgggcgccgatatcgaggtgatcaacccgaggctggctggcggcgaggacgtcgccgacctgagggtgaggtccagcaccctgaagggcgtgaccgtgccagaggacagggccccgagtatgattgacgagtacccgatcctggccgtggccgctgccttcgccgagggcgccaccgtgatgaacggcctcgaggagctgcgcgtgaaggagagcgacaggctgagcgctgtggccaacggcctgaagctgaacggcgtggactgcgacgagggcgagactagcctggtggtgaggggcaggccagacggcaagggcctgggcaacgcttccggcgctgccgtggccacccacctggatcacaggatcgccatgtcgttcctcgtgatgggcctcgtgagcgagaacccggtgaccgtggacgacgccaccatgatcgccaccagcttccccgagttcatggacctgatggccggcctgggcgctaagatcgagctgagcgacaccaaggccgcctgatcatctagagctcgccaaggttcaattaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctcccaggttcttgctttctaccgtttcttgctgaatgttaacttgattctgtcaggctcagtttcccactatggcttacagcttaacgtgtttggtttgttgaatgttaacttggttttgtcaagctcagttttttactctggcttacagcataacatgtttgacttttggttttgctgctttgttattgggttctgggtagttcttgatgaatccaaaagatcatgtgcacagccatattatctatttaagcgatccaggttattactatgaaaggatgccttctagctaaggagtagttaggttttttcttcaaggttaaattttctcgatgctctagtgttcctgtgaccataatcataataattcctttgaaagctctatggtccctggaagcagggcatacaatgcaagacagcaacttgatcacatcaactgaagtatacagggttctcttaactcttggtgacttcggtttaatggaccggttgtactcgtgttctatccgtaaccgttgtgatgtcttgtgtgtttggttgcgggatagctgggaccacgacgtttccgtctaattctgatggatagctatagacggcactgagatggttatattataacctctgatcctgaactctacgagatcgtctcatccgtcattgccaccaaatacaccattaaattactaattagctaacggaccctatttgtactcattccatgtctcataaactttgggcaccatccatccaacacatccaatctaaacacaccaaacgatggggaatggaaagagcagtattcgattcaacaatggcaaacaaatatcactgaattagaccaagaataaacctaattagacaacgacctcccaaccatcattcgtcaggctgtaaagaagataaagctgccatggggcatggatcaagcagaacaccagagatgaatccaaacacacagaaaatcacgcgcgctgtctacaatgacaacaagccccacatttcattgcagtacactgggctacaaaggcacgtacaacaaagagctagggaaacattgcggagggcacgagagagcagctaacttgacaatatagcagactgagcttgcactgttagcaggcgaggaagggaatcatggggacggagaatggggtccatgcccgcgaaggagaaggcggacgccgccacggtggcaccggcgcacgcgcacacagggaacccgcacaggcagccatggatgctgcctcgccattgcgccggtcgtctctgccacgctcctctctctctcccgctgcatcgccgtggatggggcaagcagagagcagggactgcgacgatctgggcggaggactcgccttggagagcgcggacgcagacgggattctagggagagagcgaagacggggcgcgcgcggcgctcgcgcggcgtggtggcggcgagattagcgggggtggggggagggcggagccgtggtgagggtgtggacgccctccttaccctcttaagtagtagtagagatataatccgttccaaaatatccatccgttcaatttatatttcgtttgatctttttaccctaaatttgattgactcatcttattaaaaaagttcataactattattaatctttattgagatatcatttagcatataatatactttaagtgtggttttagattttttttaaaaaaaaaaattcgcaaaaattaaatgaaacgacccaatcaaacttgaaaagtaaaactaattataaatttgaacggaaggagtaagaggatgtttgaatgtactagagctaatagttggttgctttaaaatttgctagtagaattagctagctaataaatatctagataactattagctaatttgctaaaacagctaatagttgaactattagctagattgtttggatgtattcggctaattttaatggctaactattagctatagtacaatattcaaacacctcctaattaaaatggacaaatatctcttcttttggtcccttgcgttagatttttcatatctccttatttagtataaaagaatcatcaaaaagtggacaacccctagtggaacaccattttagtagtggttgcatgaaacctttcgcgcaccagtttctatgtgtcactctaaaaatgggacagcatgtacgtagtgcctatatatatacaagtcatctatcgttgcctcctcagttcatcactaatcacacttattgtgccctcgacgagtatctatagctagctcattaatcgattcgggggtgtgttgtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctggaggccaggctgcaggagctggacgggccggaggcgaggctggcggactacttcgactacatcgccggaaccagcaccggcggtctcatcaccgccatgctcaccgcgcccggcaaggacaagcggcctctctacgctgccaaggacatcaaccacttttacatgcagaactgcccgcgcatctttcctcagaagtgagtccgatgctgccgccattgttcttgcatccatccagcatcgtacgtacgtcctctatacatctgcggatcatcatgtgcgcatgtttgtggcatgcatgcatgcatgtgagcaggagcaggcttgcggccgccatgtccgcgctgaggaagccaaagtacaacggcaagtgcatgcgcagcctgattaggagcatcctcggcgagacgagggtaagcgagacgctgaccaacgtcatcatccctgccttcgacatcaggctgctgcagcctatcatcttctctacctacgacgtacgtacgtcgtcacgaatgattcatctgtacgtcgtcgcatgcgaatggctgcctacgtacgccgtgcgctaacatactcagctctttcctatctgctgcgccaatttgcaggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccggtaactgactagctaactggaaaacggacgcacagactccatgtccatggcggcccacaaggtcgatgctaattgttgcttatgtatgtcgcccgattgcacatgcgtagacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatatatgttcttgaatataaaattgataaccaaattaaaattcgaaccatcacttatacataattttactttattttttataaaacgtgaacgggaaggactaccgtgaatgactatagaaccaatcatactagtataaaatatatgatgacactacgggagagacaaactttgtctggcgctaaatattttgccgagtgtgaattcacgggcactaggcaaagatcttctttgccgagtgttacgctgggcaaagtaagacactaggtaaatcagtcatttgccgagtgtccgccactaggcaaagcaaaacactggcaaatcaaaagtttacctagtgccagacactaggcaaaaaaaaaacgctcggcaaatcggaagtttccctagtgccagacactagacaaagaaaaacacttgataaactagcgtcgtcagctaacaccatccaccaaccgttaacgttgccgagtatctgacttcgacactcggcaaagaaggtctctttgcctagtgtcggtctggaacactaggcaaagaggcactttacctagtgtcgtattttgacactcagtaaaataattttttttctttctgcttccaaactttttatgatgtgttcctatagcacctagaactacatgtcaagttttggtaaaatttttgaagtttttgctatatttacttaatttattttatttaattgaatttcttttgataattcaaatttgaactcggcaaggtaagaagcgagggtagcctggaaacacactttgcctagtgttacactcggtacaggagcctcccctgcctagtgctgcactcgacaaaagattcgcctttgcctagcgctgcactcggcacaggagtcgcctttgcctagtgctgcactaggcaaagcctccgttaccgtgccttccatcgtcggaccgcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcag

SEQ ID NO: 94 - DNA, 15757 bp, Artificial Sequence
  Expression cassette of construct 22467
  promoter (214)..(2339)
  gene (2341)..(3018)
  terminator (3024)..(4036)
  enhancer (4044)..(4237): eFMV
  enhancer (4244)..(4536): e35S
  promoter (4544)..(8537): Ubi
  gene (8538)..(9995): EPSPS
  terminator (10009)..(11008): Ubi
  gene (11028)..(15538): GRMZM2G062320
  promoter (11028)..(12596): pPGM
  exon (12597)..(12834): PGM exon1
  Intron (12835)..(12974): PGM intron1
  exon (12975)..(13198): PGM exon2
  Intron (13199)..(13295): PGM intron2
  exon (13296)..(13382): PGM exon3
  Intron (13383)..(13718): PGM intron3
  exon (13719)..(13787): PGM exon4
  Intron (13788)..(14102): PGM intron4
  exon (14103)..(14204): PGM exon5
  Intron (14205)..(14304): PGM intron5
  exon (14305)..(14424): PGM exon6
  Intron (14425)..(14492): PGM intron6
  exon (14493)..(14540): PGM exon7
  terminator (14541)..(15538): tPGM
cctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggacccgaaagtagcaaacaacaggttcatgtgcactataaaaagacaaaattctcgagtttcatcttttattccacataagccttatattttccattttcatatgatttttagtttaagtttgtgtcttaactttttcgttaatacgtaattctatgcattatggatgcgtgaagtatttttgtttaaaaaaatgaaatgtcaaaatacgttttgtgatctatttccatgttttcacctaacaggtggtttttactatatattctgccataactctagccttagatgtaaatcgaaaaaaaatgagagatgagctggagatagccttagatgaagcgtctgaaatataaaagaaagagtaatgttgaacgcagtaggtgtagcagctgtagttccatctctaggaaagggaactgcaatccgggctccgggcctcgcgcaatctggcctgtcgtgtagatgcagccctgtccatgacggcccaagcaacgcccgcggctctcgatccaccacggaacccactccgacacacactgacacacacatgctggatgtggatgtgctgtccaattattagtagcaattcggtaggcacaggcacgtactggccggtgttttagctgtaagtaccgaaccaatcacggttaagaaccgattaatccgtgcccagccgccgagtgcgttcgtacgtgcatcggatgcactgcatgaattgagagcatcatcatatcatacgcaggagtagtacgacgccgctgctgtcttgtccggctaatgctttgctcacagattagtccatcgcccacggtcggtgtggtgtggatcgctgatgccactgctttttgtttggtttttattcccctgataatcctccgcgtccctgaatgtatctatttattttcattccgaaatccctttcacgaaaaagaaaacgaataaaaagagagttacgaatacgcttccggcggcccacatcaccttccagcgaacatcgcgccgcgctgacgtgtcgcccatcgcggccgtccatatcgccatccgacgaccgtggaagctggcagcggccgctccgttccgtcgaaggggcaggtcagtcaggtcacccacacggccacacccgcgcgggggatacgcggtggaaaacccggcgaccacatcaaaacacgaggcgtctcccgcaggactggtcactcggcacgcaggcagaggcagcacagcagcagccagctccatccatcctctttcccctcctcgcttcgcttcctcggcggattcctcctccctcggccgtccccgtccccttcttcgccgcgccagctcgcccgagttggtacgcccatcctctgctgtactccccccgttcctgctgtgcgaaaccgagcacccaaaccctagcctaagctattcgcatcgcaaactctattgagcgacggatcgcgaaacgcgcgccgccgcattcggacgagacctcgtggcccgtaccttcctactctaccgtcgtcgccggagaccagctcaccggttagggtttcgggattaggggcttggggcttggattcccgggggactccatacccggtggccttagaaggggaagggggcccagcggtggtggtggttcgactgtcagcgagcgagacggcggggcaccgccgatcgggcgtcgctggacatttgattgagctgggcaggcgaaggcgtggagcttgctcttcgattgggattagaggagggcggaggtggtatggtgggcggctcggctggctcaatggagccgctggccggtggtggggcaggcgagatcacgctctctcatagagcgtaatgggttgcgtaacacactcctgtttgtatttcgatccgatctaataattaaagtttatttacgtggtgcacatgtagaattttcccatgcccactgctaacttggattggatttttgccaaaaaaacgggtgtgcacccaatcacttatagtgaaaccgttgtgtgtttgatgtgcttctaaccaagtacaaatccagtgaaaacacacctaccattcaacaatccacattttggttgcaattatcagcattctagaaaggtgcatgtgcccattgatacacttgctattggtgcaggcaaacccaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtaggagctcgcatcatgatcatgcatcatggactcggcctactactgtggatttgtatgccattatagacttggtgctgtgaaagactgcttgatgatttgcgggtttgttgctgtgtaaaaaaaggtcccttggctcccagaagaccatgaaggttcggatctatcatgtaattccttgttatctgccaattatgtatggactatggacatgtgttgcgctgttcaacttactactacaaataagtaatcgatatgttcccttcccatgtctcggtgacaattgtctggagaagcttaggggtcgtttgtttgggattatgtctggagaaacttattttaaactaagtgtgagttcaagttaagttagattatataatctaggcagattataattccaagcgaacaggtccttagtgtttttggaaaatcctaggtgttcttttggctacattgttgtgtgtgcagatcccttgttggtctgtaagcgtggggaagtaagaatcgtccgtttctactgaagacctgctcgagttaggcaccgaggatgccggtaaccaaacagagcaatagtgtctctgtgggcacagtggagtgtgaatctgtgtgatgcaaatccgtcatttgtttagcaaaatttccagcgttgcatgatgcagtttctttaacacggacttaagggaagggaaaaaaatgttgagccaggagatccttcaatgtgttagactgacgtgatagccaactaaaccacgacgcaatgttgtcgttaatgacaaaaaaactatttgttcctaaatccttggcgacattgcatggctgtctcatgagataatggtctcatctcttatttatctcttatttatagccggaagtggtagtgacccctgcttgattgctcgtatgccatctcaagttctcaaccgtgtcgagcagccattttcccatctcaagcgcatcatcgtttcgtttgacctcatctgctatcctgctcctagtgcaaatcacatgcgacagaaagtgtgcggacccagctgcttgtggggaccagacaaaaaaggaatggtgcagaattgttaggcgcacctaccaaaagcaactttgcctttattgcaaagataaagcagattcctctagtacaagtggggaacaaaataacgtggaaaagagctgtcctgacagcccactcactattgcgtttgacgaacgcagtgacgaccacaaaactcgagacttttcaacaaagggtattatccggaaacctcctcggattccattgcccagctatctgtcactttattgtgaagatagtggaaaaggaaggtggctcctacaaatgccatcattgcgataaaggaaaggctatcgttgaagatgcctctgccgacagtggtcccaaagatggacccccacccacgaggagcatcgtggaaaaagaagacgttccaaccacgtcttcaaagcaagtggattgatgtgatatctccactgacgtaagggttgacgaacaatcccactatccttcaagctttggaaaaccaaaacaacgaataagcaaactgcaggaaaagtatgcagtggaaaccaacccagattcggacgataggaaagtatcaagtgaatgatttgccaggaaaaggagaggggtaaaaaggggcgaagatttagaagatctaaagcacaagaaccagagattagattgaacaatagggaacttggagcatcctttttttcttcagggaaaaactgaaaatccaaaccatgttgagcaaaaccgagtgggattggaaaccaaaaaacccgagataaagaaactcgagaaaaagcatgaaatcgaaaccaacttcagtaaaacaaaaggaggacagaaaagaaagtcggaagctataaagaatacattaacattcagtgaaacagcatgctgtcttcttctttttttatgcacaacagagcatacatatataccttcccaggctgaggacttggcggaggagagccgcggataggttggcggtgcagacggtctggacgggcccgaagacggagacgaacagcgggcccttcctgcccaggcaccacgcttggaacgccaagcacgcgccaaccgcggccccgccgaggacgacgatccccgcgacaagcgtggcgtcgatcctgggcgaccccaagccgaggaacctcccttccaggacgagccgtaggacggcggtgagagaggcacccgtcgcggaggtggcgcagcacaaggtgagcagcgcggggaaggcggcgagcgtggcggcctgcaggacggtgacgagcgcgaagacggtgacgccggcgacgaggcagcagcagccgaggatccagtcgtaggaggaagccggaccaaaccgggcaatgcaacctgcagatgcactagacggaggtaacgaggaggaggagaaaacagagcaagagcaggcggagagaagatagagcaaaacacgagtgaggcacagcgtaagcactcggtagaagtctccagaggcgaggtgcgcacaggagaacagatgagtaaagtcagccaaggatccacgatccaacggctacgaatttttggagtgacgtggataggctcaaaggcgccatttccatccggctttatagtattttaaaaaaattcattttcctccctctagtgtgtgcggaggcgtgagcccgtttaacggcgttgagaagtctaacggacaccaaccacaaccaggaaccagcgccggccgcgccgccgagtgaagcagactgcatacggcacggcgcggcatctctctggctgcctctcgagagttccgcccccaccttcccgcggtagcgtggtggtttcgctttccgctgtcggcatccggaagttgcgtggcagagtggacggagacgaggccgggtcctccagctcctctcaaacgtcacggcaccggcatccggcagccagcgcggtccttcccaaccactcgttcccaacccatcccccttcctcgcccgccgtcataaatagccagccccatccccagcttctttccccaacctcatcttctctccttttgctctgaacgcacacaccgcccggtctccgatctccgatccccgatcccctcgtcgatcctaggtacggcgaccatcctaccccccccccccccccctctctctctgccttctctagatcggcgatccgatccatgcttacttggttagggcctgctaactatgttcatgtttgcgttagatccgtgcatggacgcgatctgtacacaccagacgcgttctgattgctagctaactcgccagtacctgggaatcctgggatggctgtagccggccccgcacgcagacgggaccgatttcatgattctctatttttttctttgtttcgttgcctagggtttcgttcgatcgatccgcgttattctttatttccatatattctggtacgatgttgatacggttcgaccgtgctgcttacgttctgtgcgcttgtttgccgggtcatttttaccttgccttttttgtatggtttggttgtggcgatgtggtctggtcgggctgtcgttctagatcggagtagagtgctgtttcaaactgtctagcggatctattagatttggatctgcatgtgtgacatatatcttcgtagttaagatgatgcatctgtatgtgtgacatgcggatctattagatttggatctgtatgtgtgacatatatcttcgtagttgagatgatgcatctgtatgtgtgacatatatcttcgtagttaagattatgcatggaaatatcaatcctttagataaggacgggtatacttgttgctgtgggttttactggtacttcgatagatgcatatacatgatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctatatattctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcagatccagatcttcgtaaaccatggctctggtggctaggccagtgctgtctgctagagtggctgcttctaggccaagggtggccgctagaaaggctgtgagggtgagcgctgccagtcacggcgctagctctaggccagccaccgctaggaagtccagcggcctgagcggcaccgtgcgcatcccaggcgacaagagcatcagtcaccgcagcttcatgttcggcggcctggccagcggcgagactaggatcaccggcctgctcgagggcgaggacgtgatcaacaccggcaaggccatgcaggctatgggcgctcgcatccgcaaggagggcgacacctggatcatcgacggcgtgggtaatggcggcctgctggccccagaggccccactggacttcggcaacgccgccaccggctgcaggctgactatgggcctggtgggcgtgtacgacttcgacagcacctttatcggcgacgccagcctgaccaagaggccgatgggcagggtgctgaacccgctgcgcgagatgggcgtgcaggtcaagagcgaggacggcgacaggctgccggtgaccctgaggggcccaaagaccccgaccccgatcacctaccgcgtgccaatggccagcgcccaggtgaagtcagccgtgctgctggccggcctgaacaccccaggcatcaccaccgtgatcgagccgatcatgacccgcgatcacaccgagaagatgctgcagggcttcggcgccaacctgaccgtcgagactgacgctgacggcgtgaggaccatcaggctcgagggcaggggcaagctgaccggccaggtgatcgacgtgccgggcgacccaagcagcaccgccttcccactggtggccgccctgctggtgccaggctctgacgtgaccatcctgaacgtgctgatgaacccgagccgcaccggcctgatcctgaccctgcaggagatgggcgccgatatcgaggtgatcaacccgaggctggctggcggcgaggacgtcgccgacctgagggtgaggtccagcaccctgaagggcgtgaccgtgccagaggacagggccccgagtatgattgacgagtacccgatcctggccgtggccgctgccttcgccgagggcgccaccgtgatgaacggcctcgaggagctgcgcgtgaaggagagcgacaggctgagcgctgtggccaacggcctgaagctgaacggcgtggactgcgacgagggcgagactagcctggtggtgaggggcaggccagacggcaagggcctgggcaacgcttccggcgctgccgtggccacccacctggatcacaggatcgccatgtcgttcctcgtgatgggcctcgtgagcgagaacccggtgaccgtggacgacgccaccatgatcgccaccagcttccccgagttcatggacctgatggccggcctgggcgctaagatcgagctgagcgacaccaaggccgcctgatcatctagagctcgccaaggttcaattaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctcccaggttcttgctttctaccgtttcttgctgaatgttaacttgattctgtcaggctcagtttcccactatggcttacagcttaacgtgtttggtttgttgaatgttaacttggttttgtcaagctcagttttttactctggcttacagcataacatgtttgacttttggttttgctgctttgttattgggttctgggtagttcttgatgaatccaaaagatcatgtgcacagccatattatctatttaagcgatccaggttattactatgaaaggatgccttctagctaaggagtagttaggttttttcttcaaggttaaattttctcgatgctctagtgttcctgtgaccataatcataataattcctttgaaagctctatggtccctggaagcagggcatacaatgcaagacagcaacttgatcacatcaactgaagtatacagggttctcttaactcttggtgacttcggtttaatggaccggttgtactcgtgttctatccgtaaccgttgtgatgtcttgtgtgtttggttgcgggatagctgggaccacgacgtttccgtctaattctgatggatagctatagacggcactgagatggttatattataacctctgatcctgaactctacgagatcgtctcatccgtcattgccaccaaatacaccattaaattactaattagctaacggaccccttgcctcggttacaattgagtttgtcataagaaagaatgagaaagaaaagaagcaatccaagcgcaagagctcaaaggaacacaagtcactctctcactagtcactattgattggaattgaactagggacttgggagaggattttatctctttggtgtgtcttgtattgaatgctatagctcttgtaatgtgtagaatgttggaaacttggatgccattgaatgtggggtggttggggtatttatagccccaaccaccacaatgtggtcgttggaagtctgctgtcgcatggcgcaccggatagtccgatgcgccaccggacactgtccggtgcgccagccacgtcagccagccgttggggttcgaccgttggagctctgacttgtggggcctctgggctgtccggtggtgcaccggacaggtcctgtagactgtccggtgcaccaactgcgcgtgctctgacctctgcgcgcgcaggcgcgcattaaatgcgttgcagtcgaccgttgcgcttgaagtagtcgttgctccgctggcacaccggacagtgtccggtgaattatagcggagcggcctccattttcccgaaggtagcgagttcagcgtcgagttccctggtgcaccggacactgtccggtggcacaccggacagtccggtgcgccagaccagggcacacttcggttgtctttggctctctttgtttgaaccctttcttggtctttttattggtctattgtgaacctttggcacctgtaaaacttataatctagagtaaactagttagtccaattatttgtgttgggcaattcaaccaccaaaatcaattaggaaaaggtgtaagcctatttccctttcaggaggcgtacgtgagagggagaggtgaaaaggaacaacgcgtataccagataaggtcccacagcctaagtaggtagccttctaatatctctactaactattaaggagagagtgtagactgcccccgctccctacccaacgccccccgctacctgttcaccgcgcgccagcgaaacctccgcacgcccactgcccatctgttccccgtgcgccagcgaaacatccgcacgcccgcggcccgcctgttccccgcgcatcccgctgcacgacttctgctaccgcaacggccacccacgcacgcccgcctgttcaccgcgcatcccgctgacctccccttcacgctcgcacacgctccgttcccccaccccaccgcaatccccgacgctataagagcggtaaccaactccatctccctggtgccacgcattgttgagttcttaaggtgcgtttcgttgaggacttgttcatttttgttggtcatgtattccattttactgctctaccattttgtggaataaagggaggaatgttttcactagaagagttcatcaatcttatgttggtttcttggatcagttttgctctatggctaaatggtcgaattgagcctatttcattataaagttagcgagcgaataattgttcagcctcttcctagaactcattaccagtagaatcagttactaactgcttttctttttcttggattagaatggctggggctatctctcaccatgcgctagcattttcacaatcccactggtgcagtgcgaagaactctagattcggaaagaggacgggcaatgctcgcctggtttatctaaaaggaagatgtggttcaggcagcagaaaactgggtttgatgtgggcctcgagctcgcagtcttctgtcatggagccgacgcacctaccatctgatggcaacagcagccacaccccaaaaaaatcaagtaattttaacgacctcctatggtggttatttgtttttaatttgagaaaactatccatttgacacatttaactttgggcttctcagaatttgggggcatataataagatctgctaatctgttatctctatgtcgttgtaggtgaaagcgctcttatattgatttggcatggtgaatccctgtggaacgagaaaaatctatttcctggctgcatcgatgtacccctgacaccgaagggtgttgaggaggccattgaggcaggtaaaaggatatgcaatatcccaatcgatgtgatatatacttcatcactgatttgtgctcagatgaccgcaatgcttgccatgatgcagcatcgacgcaagaaggtttgtgtctttcctttgaaattccagtaatttcttctagcatttgtatgaacttgccggagaaatcatgctttgctggtgatatatgtatttatagatcctagttatcacgcataatgagagtgaacaagctcacaggtggagtcagatatacagtgaggagacaatgaaacagtccattcctgtcatcacagcttggcaattgaatgaacggatgtaatactttctccatactctttgatttgctaattactccctctgtctcaaaatagtattaattttagctcttgatttttatgtctatattcaaatagatgatgataaatctagattctagacacaaatataaaacatatacatcaagtattatatgaatctattaatttactaagaccaattttaatttgggacagagggagtatacgattataatagttgtttgactgtgcttctctttaaatatcccttgacatttctaggtatggtgagctacaaggccttaacaagcaagaaactgtagatcgatttggcaaagaacaagttcatgagtggcgccgcagttatgatattcctccgccaaatggagaaagtctagagaagtgtgctgagagagctgttgcttatttcaaagatcaggcacatctagcaaggccactttacactaattgaaagatacactttttacttgggttattggtcttgctgcagtattggtatgcatgctaaaggttattcttgaatcgatgaattcctctactatgggatgcagaaatgcatgtgcttagttttctttctattgtgctagctcatatcaaatttataacctgaattttttatttatgttcgactctaaaaaacagttttttctagctcgatttgacctatagtaatttttccgtaatagattattccacaacttgtggctggaaaacatgtgatggttgctgcacatgggaattcacttcgttcaattataatgcatctggacaaattaacttctcagaaggtaattcactgtcgtttttgtctttccatcaaaaaggactcggctaaacagaacatgtagcattatgttaagtttgggagtgagcctttcgtcccttcaggtaataagccttgagctgtctactggcattcccatgctttacatattcaaagagggaaagtttattcgacgtgggactccagtaggaccttcggaggccagtgtttatgcttataccagggtaagattctttcccccacatgttctaccataggacgatactccagtttacaaaccttatctgtacagaccaaacgatttgctgagcacattacatttcagaacaaattggcctagaagataaggggtgtttggtttgagaaatcactctattcaaaatgagatggtgtatcatgggtccatttctcaaatttggtgggatgaccctattcctcatattagtactaactaggtgagtgtccgtgcgttgcaacgggaacatataataacatgataacttatatacaaaatgtgtcttatattgttataagaaaatgtttcataatccatttgtaatcctggccatacataaattttgttattttaatttagctgtttcactactacattgcaaccatcagtatcatgcagacttcgatatatgtcacgatttgcatagtcttatcattgaagagcacgtgtcacacctaccggtagaagttccctcgtacattgtcagggggacctcatggtcgtcgctaaagccggcgactctctggttgttctgggcaccgcatccgacgacaacaccgtcacgctgtccagctcatcatccacctgaagatcaacctgccacgtaagtcggtagtgaccggccatgaattcttgtgcgctggggcaacgggcgttgcattccgttgtgtgagtgttttagaacaagatgtatgtaaaggagtagcacatccggtggtgcaatggctaggtgtactacctcgctgatgagctcgcggtgcacttcgtttagcagcccagccaagagtcatcggtacttgccatgtcgtgcgtgttcgacgactactatatcaaggactgtggcgtcctcttggcgccagaggtgaggagtaccgacagcaatgacctctcgccatcgtcggggtagcttttgtgctggcccgcctttaattctcttcgtaaacacatacacttgccttttttgtttaagcaagtgagtatagtggtgcgtacctgatgactgacaatgtacgaggaaacttctactggcaggtgtggcacgtgctcttcaatgatgagaccatgtaaatcgtgacatatatcgaagtctgcatgatactgatcggaccgcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcag

SEQ ID NO: 95 - DNA, 15355 bp, Artificial Sequence
  Expression cassett of construct 22503
  enhancer (214)..(407): eFMV
  enhancer (414)..(706): e35S
  promoter (714)..(4707): Ubi
  gene (4708)..(6165): EPSPS
  terminator (6179)..(7178): Ubi
  promoter (7198)..(9285): pPLA2m
  stem_loop (9298)..(10212): targeting exon2 of PLA2
  terminator (10223)..(11218): tPLA2
  promoter (11226)..(13349)
  gene (13352)..(14131)
  misc_feature (14039)..(14128)
  terminator (14138)..(15136)
cctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggacccagctgcttgtggggaccagacaaaaaaggaatggtgcagaattgttaggcgcacctaccaaaagcaactttgcctttattgcaaagataaagcagattcctctagtacaagtggggaacaaaataacgtggaaaagagctgtcctgacagcccactcactattgcgtttgacgaacgcagtgacgaccacaaaactcgagacttttcaacaaagggtattatccggaaacctcctcggattccattgcccagctatctgtcactttattgtgaagatagtggaaaaggaaggtggctcctacaaatgccatcattgcgataaaggaaaggctatcgttgaagatgcctctgccgacagtggtcccaaagatggacccccacccacgaggagcatcgtggaaaaagaagacgttccaaccacgtcttcaaagcaagtggattgatgtgatatctccactgacgtaagggttgacgaacaatcccactatccttcaagctttggaaaaccaaaacaacgaataagcaaactgcaggaaaagtatgcagtggaaaccaacccagattcggacgataggaaagtatcaagtgaatgatttgccaggaaaaggagaggggtaaaaaggggcgaagatttagaagatctaaagcacaagaaccagagattagattgaacaatagggaacttggagcatcctttttttcttcagggaaaaactgaaaatccaaaccatgttgagcaaaaccgagtgggattggaaaccaaaaaacccgagataaagaaactcgagaaaaagcatgaaatcgaaaccaacttcagtaaaacaaaaggaggacagaaaagaaagtcggaagctataaagaatacattaacattcagtgaaacagcatgctgtcttcttctttttttatgcacaacagagcatacatatataccttcccaggctgaggacttggcggaggagagccgcggataggttggcggtgcagacggtctggacgggcccgaagacggagacgaacagcgggcccttcctgcccaggcaccacgcttggaacgccaagcacgcgccaaccgcggccccgccgaggacgacgatccccgcgacaagcgtggcgtcgatcctgggcgaccccaagccgaggaacctcccttccaggacgagccgtaggacggcggtgagagaggcacccgtcgcggaggtggcgcagcacaaggtgagcagcgcggggaaggcggcgagcgtggcggcctgcaggacggtgacgagcgcgaagacggtgacgccggcgacgaggcagcagcagccgaggatccagtcgtaggaggaagccggaccaaaccgggcaatgcaacctgcagatgcactagacggaggtaacgaggaggaggagaaaacagagcaagagcaggcggagagaagatagagcaaaacacgagtgaggcacagcgtaagcactcggtagaagtctccagaggcgaggtgcgcacaggagaacagatgagtaaagtcagccaaggatccacgatccaacggctacgaatttttggagtgacgtggataggctcaaaggcgccatttccatccggctttatagtattttaaaaaaattcattttcctccctctagtgtgtgcggaggcgtgagcccgtttaacggcgttgagaagtctaacggacaccaaccacaaccaggaaccagcgccggccgcgccgccgagtgaagcagactgcatacggcacggcgcggcatctctctggctgcctctcgagagttccgcccccaccttcccgcggtagcgtggtggtttcgctttccgctgtcggcatccggaagttgcgtggcagagtggacggagacgaggccgggtcctccagctcctctcaaacgtcacggcaccggcatccggcagccagcgcggtccttcccaaccactcgttcccaacccatcccccttcctcgcccgccgtcataaatagccagccccatccccagcttctttccccaacctcatcttctctccttttgctctgaacgcacacaccgcccggtctccgatctccgatccccgatcccctcgtcgatcctaggtacggcgaccatcctaccccccccccccccccctctctctctgccttctctagatcggcgatccgatccatgcttacttggttagggcctgctaactatgttcatgtttgcgttagatccgtgcatggacgcgatctgtacacaccagacgcgttctgattgctagctaactcgccagtacctgggaatcctgggatggctgtagccggccccgcacgcagacgggaccgatttcatgattctctatttttttctttgtttcgttgcctagggtttcgttcgatcgatccgcgttattctttatttccatatattctggtacgatgttgatacggttcgaccgtgctgcttacgttctgtgcgcttgtttgccgggtcatttttaccttgccttttttgtatggtttggttgtggcgatgtggtctggtcgggctgtcgttctagatcggagtagagtgctgtttcaaactgtctagcggatctattagatttggatctgcatgtgtgacatatatcttcgtagttaagatgatgcatctgtatgtgtgacatgcggatctattagatttggatctgtatgtgtgacatatatcttcgtagttgagatgatgcatctgtatgtgtgacatatatcttcgtagttaagattatgcatggaaatatcaatcctttagataaggacgggtatacttgttgctgtgggttttactggtacttcgatagatgcatatacatgatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctatatattctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcagatccagatcttcgtaaaccatggctctggtggctaggccagtgctgtctgctagagtggctgcttctaggccaagggtggccgctagaaaggctgtgagggtgagcgctgccagtcacggcgctagctctaggccagccaccgctaggaagtccagcggcctgagcggcaccgtgcgcatcccaggcgacaagagcatcagtcaccgcagcttcatgttcggcggcctggccagcggcgagactaggatcaccggcctgctcgagggcgaggacgtgatcaacaccggcaaggccatgcaggctatgggcgctcgcatccgcaaggagggcgacacctggatcatcgacggcgtgggtaatggcggcctgctggccccagaggccccactggacttcggcaacgccgccaccggctgcaggctgactatgggcctggtgggcgtgtacgacttcgacagcacctttatcggcgacgccagcctgaccaagaggccgatgggcagggtgctgaacccgctgcgcgagatgggcgtgcaggtcaagagcgaggacggcgacaggctgccggtgaccctgaggggcccaaagaccccgaccccgatcacctaccgcgtgccaatggccagcgcccaggtgaagtcagccgtgctgctggccggcctgaacaccccaggcatcaccaccgtgatcgagccgatcatgacccgcgatcacaccgagaagatgctgcagggcttcggcgccaacctgaccgtcgagactgacgctgacggcgtgaggaccatcaggctcgagggcaggggcaagctgaccggccaggtgatcgacgtgccgggcgacccaagcagcaccgccttcccactggtggccgccctgctggtgccaggctctgacgtgaccatcctgaacgtgctgatgaacccgagccgcaccggcctgatcctgaccctgcaggagatgggcgccgatatcgaggtgatcaacccgaggctggctggcggcgaggacgtcgccgacctgagggtgaggtccagcaccctgaagggcgtgaccgtgccagaggacagggccccgagtatgattgacgagtacccgatcctggccgtggccgctgccttcgccgagggcgccaccgtgatgaacggcctcgaggagctgcgcgtgaaggagagcgacaggctgagcgctgtggccaacggcctgaagctgaacggcgtggactgcgacgagggcgagactagcctggtggtgaggggcaggccagacggcaagggcctgggcaacgcttccggcgctgccgtggccacccacctggatcacaggatcgccatgtcgttcctcgtgatgggcctcgtgagcgagaacccggtgaccgtggacgacgccaccatgatcgccaccagcttccccgagttcatggacctgatggccggcctgggcgctaagatcgagctgagcgacaccaaggccgcctgatcatctagagctcgccaaggttcaattaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctcccaggttcttgctttctaccgtttcttgctgaatgttaacttgattctgtcaggctcagtttcccactatggcttacagcttaacgtgtttggtttgttgaatgttaacttggttttgtcaagctcagttttttactctggcttacagcataacatgtttgacttttggttttgctgctttgttattgggttctgggtagttcttgatgaatccaaaagatcatgtgcacagccatattatctatttaagcgatccaggttattactatgaaaggatgccttctagctaaggagtagttaggttttttcttcaaggttaaattttctcgatgctctagtgttcctgtgaccataatcataataattcctttgaaagctctatggtccctggaagcagggcatacaatgcaagacagcaacttgatcacatcaactgaagtatacagggttctcttaactcttggtgacttcggtttaatggaccggttgtactcgtgttctatccgtaaccgttgtgatgtcttgtgtgtttggttgcgggatagctgggaccacgacgtttccgtctaattctgatggatagctatagacggcactgagatggttatattataacctctgatcctgaactctacgagatcgtctcatccgtcattgccaccaaatacaccattaaattactaattagctaacggaccctatttgtactcattccatgtctcataaactttgggcaccatccatccaacacatccaatctaaacacaccaaacgatggggaatggaaagagcagtattcgattcaacaatggcaaacaaatatcactgaattagaccaagaataaacctaattagacaacgacctcccaaccatcattcgtcaggctgtaaagaagataaagctgccttggggcatggatcaagcagaacaccagagatgaatccaaacacacagaaaatcacgcgcgctgtctacaatgacaacaagccccacatttcattgcagtacactgggctacaaaggcacgtacaacaaagagctagggaaacattgcggagggcacgagagagcagctaacttgacaatatagcagactgagcttgcactgttagcaggcgaggaagggaatcatggggacggagaatggggtccatgcccgcgaaggagaaggcggacgccgccacggtggcaccggcgcacgcgcacacagggaacccgcacaggcagccaaggatgctgcctcgccattgcgccggtcgtctctgccacgctcctctctctctcccgctgcatcgccgtggatggggcaagcagagagcagggactgcgacgatctgggcggaggactcgccttggagagcgcggacgcagacgggattctagggagagagcgaagacggggcgcgcgcggcgctcgcgcggcgtggtggcggcgagattagcgggggtggggggagggcggagccgtggtgagggtgtggacgccctccttaccctcttaagtagtagtagagatataatccgttccaaaatatccatccgttcaatttatatttcgtttgatctttttaccctaaatttgattgactcatcttattaaaaaagttcataactattattaatctttattgagatatcatttagcatataatatactttaagtgtggttttagattttttttaaaaaaaaaaattcgcaaaaattaaatgaaacgacccaatcaaacttgaaaagtaaaactaattataaatttgaacggaaggagtaagaggatgtttgaatgtactagagctaatagttggttgctttaaaatttgctagtagaattagctagctaataaatatctagataactattagctaatttgctaaaacagctaatagttgaactattagctagattgtttggatgtattcggctaattttaatggctaactattagctatagtacaatattcaaacacctcctaattaaaatggacaaatatctcttcttttggtcccttgcgttagatttttcatatctccttatttagtataaaagaatcatcaaaaagtggacaacccctagtggaacaccattttagtagtggttgcatgaaacctttcgcgcaccagtttctatgtgtcactctaaaaatgggacagcatgtacgtagtgcctatatatatacaagtcatctatcgttgcctcctcagttcatcactaatcacacttattgtgccctcgacgagtatctatagctagctcattaatcgattcgggggtgtgttgtcgaaggcggcattggcgagctactcgtcgcggcgtccaagcaatacctgtagcacgaaggcgatcgccgggagcgtggtcggcgagcccgtcgtgctggggcagagggtgacggtgctgacggtggacggcggcggcgtccggggtctcatcccgggaaccatcctcgccttcctggaggccaggctgcaggagctggacgcaccggaggcgaggctggcggactacttcgactacatcgccggaaccagcaccggcggtctcatcaccgccttgctgaccgcgcccggcaaggacaagcggcctctctaggctgccaaggacatcaaccacttttacatccataactgcccgcgcatctttcctcagaagtgagtccgatgctgccgccattgttcttgcatccatccagcatcgtacgtacgtcctctatacatctgcggatcatcatgtgcgcatgtttgtggcatgcatgcatgcatgtgagcaggagcaggcttgcgaaaaccccatggagatctgaacaggcttgcggccgccgtgtccgcgctgaggaagccaaagtacaacggcaagtgcatgcgcagcctgattaggagcatcctcggcgagacgaggggtcgactcgggagcatgccctttgtgcttatgcctccgttctgccttctgacgaatttggtactggaagcagatgagttttggttcactatcattctgaatttacacctgcgcttgctgtcagactaggcaaccaagtgacttttgtgactttgatcatgttcagtgtgtttccaagtcctaatcaatcaaaaagaaaaacagtttgttaacgattgtttgccatgtctatataataaagttgcttttatagtagcttagaattcaatcggccaactttatctcgtacgctgacagtaaaggtacatttaaaaggtgacaatggatagtctaatacttgaactgacaatagagacacattacatgtcagttgattaagtttgtaacagaaaaataaacaatactacataattgcaaagtttctttgatgtctttctttcaagaaacacaaatatatcaatgctacagtattgctgatgaatttatccatgttgagatgtttttctggtttctgatctgatcagtctcaattggtgtgctgtttcattttcatttgctgatgatcgtccgagtagttaattcttactaatatttagataatttggcatacaagcgaatcacgtagaacatgatacttttgaatgaatttatcaaagttttatcacttggtgagttgtttcatggttttcctactgatgtctcttcttcagatttctcgagccctcgtctcgccgaggatgctcctaatcaggctgcgcatgcacttgccgttgtactttggcttcctcagcgcggacatggcggccgcaagcctgctcggatccatgggacaagtggctttactgtcagtcacatgcttgtaaataagtagactttattttaataaaacataaaaatatatatatgttcttgaatataaaattgataaccaaattaaaattcgaaccatcacttatacataattttactttattttttataaaacgtgaacgggaaggactaccgtgaatgactatagaaccaatcatactagtataaaatatatgatgacactacgggagagacaaactttgtctggcgctaaatattttgccgagtgtgaattcacgggcactaggcaaagatcttctttgccgagtgttacgctgggcaaagtaagacactaggtaaatcagtcatttgccgagtgtccgccactaggcaaagcaaaacactggcaaatcaaaagtttacctagtgccagacactaggcaaaaaaaaaacgctcggcaaatcggaagtttccctagtgccagacactagacaaagaaaaacacttgataaactagcgtcgtcagctaacaccatccaccaaccgttaacgttgccgagtatctgacttcgacactcggcaaagaaggtctctttgcctagtgtcggtctggaacactaggcaaagaggcactttacctagtgtcgtattttgacactcagtaaaataattttttttctttctgcttccaaactttttatgatgtgttcctatagcacctagaactacatgtcaagttttggtaaaatttttgaagtttttgctatatttacttaatttattttatttaattgaatttcttttgataattcaaatttgaactcggcaaggtaagaagcgagggtagcctggaaacacactttgcctagtgttacactcggtacaggagcctcccctgcctagtgctgcactcgacaaaagattcgcctttgcctagcgctgcactcggcacaggagtcgcctttgcctagtgctgcactaggcaaagcctccgttaccgtgccttccatcgtcggaccctggagaggcatgaacccatcatgtatactcctggacttggaagaggaaatgtcaaccaaagtgaaaggttttcttctagttgctgctaagagataaattgaatactagatctctcctaagacatcggggcattcgtctggactactacacatgcgaaaattgcatcttacagtgggaagaaactatatctcacctcttcttgcggtgtaactttgcccgaagatgttggctcactgttggaatcactccgccccgaacgttggatctagcgcttgcagtgctacatattagagcaagactgacattgtcgtggagaatggaaggtattataaccatgcatgtcatggtacatatggaaatgtcaaaataactggatattcgaaaacataccgccaacggtggcggtctgcaaggaaatgttcaagattgaaatgaactacatatgcaaccaggttaagcttgagacaggagataaaagtagaaactggatacaacactttgtaacatagcgacactctctccttcctttcttttaccttagaactatacatagaatctacattcaataaaaatacagtaggtacgccgagagatttaaaatgagtaagctaacataccaactaaggccctgtttgtttcggattataatctctccagattatataatccagcgtaaataattcagcagataaacaaacacctaaattatatgttcagattatataatctatagcggagattatgataatctcgtaatctcctaagagtagcttatttgagatttttttggcaaaagacccactacccaaggttatgtaaatagaattacaatatatgacatccttctttcttcacctcaaataaacaaacaagggtactgttgtctttatgaataatctacatttatataatctagactaacaaacaactacatatagattataatatgtctagattataatctagattatataatttaaattatagtccatattatataatctataagctaaaacaaataggccctaattattagctattagttgttagctatttaaatctaagctaaaaccaactaatagcttattagttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataacgcgccacctccgctttagttctgcatacagccaacccaacacacacccgagcatatcacagtgacagacactacacggtgagcgccagaatcgttgtcctcctcgccaccctcctatccgctgccgccgcagtcgcgtcgtcctgggaggacgacaacctccaccaccacgggggccacaagtccgggcgtagcgtgcggcggtgcgaggaccggccctggcaccagcgcccccggtgcctggagcagtgcagggaggaggagcgggagaagcggcaagagcggagcaggctagaggccgacgaccgcagcggcaagggttcgtcggaggtagagcgcgagcgagagcaggaggaggagaagcagaaggaccggcggccgtacgtgttcgaccggcgcagcttccgtcgcgtggtccggagcgagcaggggtctctgagggtgctccggccgttcgacgaggtgtccaggctcctccgcggcatccgggactaccgcgtggcggtcctagaggcgaacccgcgctcgttcgtggtgcccagccataccgtagcgcactgcatctgctacgtggtggaaggtacgttcgtccggtccctgagaccacatagatcgagggcgacgccggccgtgcacgttagctgatctgttgttgcctcgtgactaggcgagggataaaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagacaatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgagatctcgagctgatccaaaaaagaagagaaaggtagatccaaaaaagaagagaaaggtagatccaaaaaagaagagaaaggtaggctccaccggatctagataagagctcggccgccgcgctcgccaaaacgagcaagaagcaacaagagggtggcgcgcgaccgacgtgcgtacgtagctgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctatttgaaaacaaccactcgtttcggcttttccagatgctccaagtcataagaatagtgatctccatagagaagggaacgttgagctggtgtttgaggttcacagatgcctcttcaaggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgagaatcggaccgcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcag

SEQ ID NO: 96 - DNA, 15441 bp, Artificial Sequence
  Expression cassette of construct 22513
  enhancer (214)..(407): eFMV
  enhancer (414)..(706): e35S
  promoter (714)..(4707): Ubi
  gene (4708)..(6165): EPSPS
  terminator (6179)..(7178): Ubi
  promoter (7198)..(9285): pPLA2
  stem_loop (9292)..(10386): targeting exon4 of PLA2
  terminator (10397)..(11392): tPLA2
  promoter (11400)..(13526)
  gene (13527)..(14204)
  terminator (14210)..(15222)
cctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggacccagctgcttgtggggaccagacaaaaaaggaatggtgcagaattgttaggcgcacctaccaaaagcaactttgcctttattgcaaagataaagcagattcctctagtacaagtggggaacaaaataacgtggaaaagagctgtcctgacagcccactcactattgcgtttgacgaacgcagtgacgaccacaaaactcgagacttttcaacaaagggtattatccggaaacctcctcggattccattgcccagctatctgtcactttattgtgaagatagtggaaaaggaaggtggctcctacaaatgccatcattgcgataaaggaaaggctatcgttgaagatgcctctgccgacagtggtcccaaagatggacccccacccacgaggagcatcgtggaaaaagaagacgttccaaccacgtcttcaaagcaagtggattgatgtgatatctccactgacgtaagggttgacgaacaatcccactatccttcaagctttggaaaaccaaaacaacgaataagcaaactgcaggaaaagtatgcagtggaaaccaacccagattcggacgataggaaagtatcaagtgaatgatttgccaggaaaaggagaggggtaaaaaggggcgaagatttagaagatctaaagcacaagaaccagagattagattgaacaatagggaacttggagcatcctttttttcttcagggaaaaactgaaaatccaaaccatgttgagcaaaaccgagtgggattggaaaccaaaaaacccgagataaagaaactcgagaaaaagcatgaaatcgaaaccaacttcagtaaaacaaaaggaggacagaaaagaaagtcggaagctataaagaatacattaacattcagtgaaacagcatgctgtcttcttctttttttatgcacaacagagcatacatatataccttcccaggctgaggacttggcggaggagagccgcggataggttggcggtgcagacggtctggacgggcccgaagacggagacgaacagcgggcccttcctgcccaggcaccacgcttggaacgccaagcacgcgccaaccgcggccccgccgaggacgacgatccccgcgacaagcgtggcgtcgatcctgggcgaccccaagccgaggaacctcccttccaggacgagccgtaggacggcggtgagagaggcacccgtcgcggaggtggcgcagcacaaggtgagcagcgcggggaaggcggcgagcgtggcggcctgcaggacggtgacgagcgcgaagacggtgacgccggcgacgaggcagcagcagccgaggatccagtcgtaggaggaagccggaccaaaccgggcaatgcaacctgcagatgcactagacggaggtaacgaggaggaggagaaaacagagcaagagcaggcggagagaagatagagcaaaacacgagtgaggcacagcgtaagcactcggtagaagtctccagaggcgaggtgcgcacaggagaacagatgagtaaagtcagccaaggatccacgatccaacggctacgaatttttggagtgacgtggataggctcaaaggcgccatttccatccggctttatagtattttaaaaaaattcattttcctccctctagtgtgtgcggaggcgtgagcccgtttaacggcgttgagaagtctaacggacaccaaccacaaccaggaaccagcgccggccgcgccgccgagtgaagcagactgcatacggcacggcgcggcatctctctggctgcctctcgagagttccgcccccaccttcccgcggtagcgtggtggtttcgctttccgctgtcggcatccggaagttgcgtggcagagtggacggagacgaggccgggtcctccagctcctctcaaacgtcacggcaccggcatccggcagccagcgcggtccttcccaaccactcgttcccaacccatcccccttcctcgcccgccgtcataaatagccagccccatccccagcttctttccccaacctcatcttctctccttttgctctgaacgcacacaccgcccggtctccgatctccgatccccgatcccctcgtcgatcctaggtacggcgaccatcctaccccccccccccccccctctctctctgccttctctagatcggcgatccgatccatgcttacttggttagggcctgctaactatgttcatgtttgcgttagatccgtgcatggacgcgatctgtacacaccagacgcgttctgattgctagctaactcgccagtacctgggaatcctgggatggctgtagccggccccgcacgcagacgggaccgatttcatgattctctatttttttctttgtttcgttgcctagggtttcgttcgatcgatccgcgttattctttatttccatatattctggtacgatgttgatacggttcgaccgtgctgcttacgttctgtgcgcttgtttgccgggtcatttttaccttgccttttttgtatggtttggttgtggcgatgtggtctggtcgggctgtcgttctagatcggagtagagtgctgtttcaaactgtctagcggatctattagatttggatctgcatgtgtgacatatatcttcgtagttaagatgatgcatctgtatgtgtgacatgcggatctattagatttggatctgtatgtgtgacatatatcttcgtagttgagatgatgcatctgtatgtgtgacatatatcttcgtagttaagattatgcatggaaatatcaatcctttagataaggacgggtatacttgttgctgtgggttttactggtacttcgatagatgcatatacatgatctaacatgcttagatacatgaagtaacatgctgctacggtttaataattcttgagttgatttttactggtacttagatagatgtatatacatgcttagatacatgaagtaacatgctcctacagttcctttaatcattattgagtacctatatattctaataaatcagtatgttttaaattattttgattttactggtacttagatagatgtatatatacatgctcaaacatgcttagatacatgaagtaacatgctgctacggtttagtcattattgagtgcctatatattctaataaatcagtatgttttaaattattttgattttactggtacttagatagatgtatatatacatgctcaaacatgcttagatacatgaagtaatatgctactacggtttaattgttcttgagtacctatatattctaataaatcagtatgttttaaattatttcgattttactggtacttagatagatgtatatatacatgcttagatacatgaagtaacatgctactacggtttaattgttcttgaatacctatatattctaataaatcagtatgttttaaattatttcgattttactggtacttagatagatgtatatatacatgctcgaacatgcttagatacatgaagtaacatgctacatatatattataataaatcagtatgtcttaaattattttgattttactggtacttagatagatgtatatacatgctcaaacatgcttagatacatgaagtaacatgctactacggtttaatcattattgagtacctatatattctaataaatcagtatgttttcaattgttttgattttactggtacttagatatatgtatatatacatgctcgaacatgcttagatacgtgaagtaacatgctactatggttaattgttcttgagtacctatatattctaataaatcagtatgttttaaattatttcgattttactggtacttagatagatgtatatatacatgctcgaacatgcttagatacatgaagtaacatgctactacggtttaatcgttcttgagtacctatatattctaataaatcagtatgtcttaaattatcttgattttactggtacttagatagatgtatatacatgcttagatacatgaagtaacatgctactatgatttaatcgttcttgagtacctatatattctaataaatcagtatgtttttaattattttgattttactggtacttagatagatgtatatatacatgctcgaacatgcttagatacatgaagtaacatgctactacggtttaatcattcttgagtacctatatattctaataaatcagtatgtttttaattattttgatattactggtacttaacatgtttagatacatcatatagcatgcacatgctgctactgtttaatcattcgtgaatacctatatattctaatatatcagtatgtcttctaattattatgattttgatgtacttgtatggtggcatatgctgcagctatgtgtagattttgaatacccagtgtgatgagcatgcatggcgccttcatagttcatatgctgtttatttcctttgagactgttcttttttgttgatagtcaccctgttgtttggtgattcttatgcagatccagatcttcgtaaaccatggctctggtggctaggccagtgctgtctgctagagtggctgcttctaggccaagggtggccgctagaaaggctgtgagggtgagcgctgccagtcacggcgctagctctaggccagccaccgctaggaagtccagcggcctgagcggcaccgtgcgcatcccaggcgacaagagcatcagtcaccgcagcttcatgttcggcggcctggccagcggcgagactaggatcaccggcctgctcgagggcgaggacgtgatcaacaccggcaaggccatgcaggctatgggcgctcgcatccgcaaggagggcgacacctggatcatcgacggcgtgggtaatggcggcctgctggccccagaggccccactggacttcggcaacgccgccaccggctgcaggctgactatgggcctggtgggcgtgtacgacttcgacagcacctttatcggcgacgccagcctgaccaagaggccgatgggcagggtgctgaacccgctgcgcgagatgggcgtgcaggtcaagagcgaggacggcgacaggctgccggtgaccctgaggggcccaaagaccccgaccccgatcacctaccgcgtgccaatggccagcgcccaggtgaagtcagccgtgctgctggccggcctgaacaccccaggcatcaccaccgtgatcgagccgatcatgacccgcgatcacaccgagaagatgctgcagggcttcggcgccaacctgaccgtcgagactgacgctgacggcgtgaggaccatcaggctcgagggcaggggcaagctgaccggccaggtgatcgacgtgccgggcgacccaagcagcaccgccttcccactggtggccgccctgctggtgccaggctctgacgtgaccatcctgaacgtgctgatgaacccgagccgcaccggcctgatcctgaccctgcaggagatgggcgccgatatcgaggtgatcaacccgaggctggctggcggcgaggacgtcgccgacctgagggtgaggtccagcaccctgaagggcgtgaccgtgccagaggacagggccccgagtatgattgacgagtacccgatcctggccgtggccgctgccttcgccgagggcgccaccgtgatgaacggcctcgaggagctgcgcgtgaaggagagcgacaggctgagcgctgtggccaacggcctgaagctgaacggcgtggactgcgacgagggcgagactagcctggtggtgaggggcaggccagacggcaagggcctgggcaacgcttccggcgctgccgtggccacccacctggatcacaggatcgccatgtcgttcctcgtgatgggcctcgtgagcgagaacccggtgaccgtggacgacgccaccatgatcgccaccagcttccccgagttcatggacctgatggccggcctgggcgctaagatcgagctgagcgacaccaaggccgcctgatcatctagagctcgccaaggttcaattaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaacttaaaagtctgctcattatgtttttttctggttatatctcctaattaactgcctgggatcaaatttgattcgctggtgtttattggacccctcccaggttcttgctttctaccgtttcttgctgaatgttaacttgattctgtcaggctcagtttcccactatggcttacagcttaacgtgtttggtttgttgaatgttaacttggttttgtcaagctcagttttttactctggcttacagcataacatgtttgacttttggttttgctgctttgttattgggttctgggtagttcttgatgaatccaaaagatcatgtgcacagccatattatctatttaagcgatccaggttattactatgaaaggatgccttctagctaaggagtagttaggttttttcttcaaggttaaattttctcgatgctctagtgttcctgtgaccataatcataataattcctttgaaagctctatggtccctggaagcagggcatacaatgcaagacagcaacttgatcacatcaactgaagtatacagggttctcttaactcttggtgacttcggtttaatggaccggttgtactcgtgttctatccgtaaccgttgtgatgtcttgtgtgtttggttgcgggatagctgggaccacgacgtttccgtctaattctgatggatagctatagacggcactgagatggttatattataacctctgatcctgaactctacgagatcgtctcatccgtcattgccaccaaatacaccattaaattactaattagctaacggaccctatttgtactcattccatgtctcataaactttgggcaccatccatccaacacatccaatctaaacacaccaaacgatggggaatggaaagagcagtattcgattcaacaatggcaaacaaatatcactgaattagaccaagaataaacctaattagacaacgacctcccaaccatcattcgtcaggctgtaaagaagataaagctgccttggggcatggatcaagcagaacaccagagatgaatccaaacacacagaaaatcacgcgcgctgtctacaatgacaacaagccccacatttcattgcagtacactgggctacaaaggcacgtacaacaaagagctagggaaacattgcggagggcacgagagagcagctaacttgacaatatagcagactgagcttgcactgttagcaggcgaggaagggaatcatggggacggagaatggggtccatgcccgcgaaggagaaggcggacgccgccacggtggcaccggcgcacgcgcacacagggaacccgcacaggcagccaaggatgctgcctcgccattgcgccggtcgtctctgccacgctcctctctctctcccgctgcatcgccgtggatggggcaagcagagagcagggactgcgacgatctgggcggaggactcgccttggagagcgcggacgcagacgggattctagggagagagcgaagacggggcgcgcgcggcgctcgcgcggcgtggtggcggcgagattagcgggggtggggggagggcggagccgtggtgagggtgtggacgccctccttaccctcttaagtagtagtagagatataatccgttccaaaatatccatccgttcaatttatatttcgtttgatctttttaccctaaatttgattgactcatcttattaaaaaagttcataactattattaatctttattgagatatcatttagcatataatatactttaagtgtggttttagattttttttaaaaaaaaaaattcgcaaaaattaaatgaaacgacccaatcaaacttgaaaagtaaaactaattataaatttgaacggaaggagtaagaggatgtttgaatgtactagagctaatagttggttgctttaaaatttgctagtagaattagctagctaataaatatctagataactattagctaatttgctaaaacagctaatagttgaactattagctagattgtttggatgtattcggctaattttaatggctaactattagctatagtacaatattcaaacacctcctaattaaaatggacaaatatctcttcttttggtcccttgcgttagatttttcatatctccttatttagtataaaagaatcatcaaaaagtggacaacccctagtggaacaccattttagtagtggttgcatgaaacctttcgcgcaccagtttctatgtgtcactctaaaaatgggacagcatgtacgtagtgcctatatatatacaagtcatctatcgttgcctcctcagttcatcactaatcacacttattgtgccctcgacgagtatctatagctagctcattaatcgattcgggggtgtgttgtcgaaggcggcattggcgagctactcgtcgcggcgtccaagcaatacctgtagcacgaaggcgatcgccgggagcgtggtcggcgagcccgtcgtgctggggcagagggtgacggtgctgacggtggacggcggcggcgtccggggtctcatcccgggaaccatcctcgccttcctggaggccaggctgcaggagctggacgcaccggaggcgaggctggcggactacttcgactacatcgccggaaccagcaccggcggtctcatcaccgccttgctgaccgcgcccggcaaggacaagcggcctctctaggctgccaaggacatcaaccacttttacatccataactgcccgcgcatctttcctcagaagtgagtccgatgctgccgccattgttcttgcatccatccagcatcgtacgtacgtcctctatacatctgcggatcatcatgtgcgcatgtttgtggcatgcatgcatgcatgtgagcaggagcaggcttgcgaaaaccccatggagatctttgcgatggcgcagatcaccaaaaagatgcttgccaacaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcgtcgactcgggagcatgccctttgtgcttatgcctccgttctgccttctgacgaatttggtactggaagcagatgagttttggttcactatcattctgaatttacacctgcgcttgctgtcagactaggcaaccaagtgacttttgtgactttgatcatgttcagtgtgtttccaagtcctaatcaatcaaaaagaaaaacagtttgttaacgattgtttgccatgtctatataataaagttgcttttatagtagcttagaattcaatcggccaactttatctcgtacgctgacagtaaaggtacatttaaaaggtgacaatggatagtctaatacttgaactgacaatagagacacattacatgtcagttgattaagtttgtaacagaaaaataaacaatactacataattgcaaagtttctttgatgtctttctttcaagaaacacaaatatatcaatgctacagtattgctgatgaatttatccatgttgagatgtttttctggtttctgatctgatcagtctcaattggtgtgctgtttcattttcatttgctgatgatcgtccgagtagttaattcttactaatatttagataatttggcatacaagcgaatcacgtagaacatgatacttttgaatgaatttatcaaagttttatcacttggtgagttgtttcatggttttcctactgatgtctcttcttcagatttctcgaggcggagccaccggcagataccccaccgggagcactgccgcgccgtgtagaggccctgctcggacgtcgaccccgtcccgatggacagcaccaggaacctgcggcagttcgacggcttcactgggtacagctcctcggccttgtccttgctggcaagcatctttttggtgatctgcgtcatcgcaaggatccatgggacaagtggctttactgtcagtcacatgcttgtaaataagtagactttattttaataaaacataaaaatatatatatgttcttgaatataaaattgataaccaaattaaaattcgaaccatcacttatacataattttactttattttttataaaacgtgaacgggaaggactaccgtgaatgactatagaaccaatcatactagtataaaatatatgatgacactacgggagagacaaactttgtctggcgctaaatattttgccgagtgtgaattcacgggcactaggcaaagatcttctttgccgagtgttacgctgggcaaagtaagacactaggtaaatcagtcatttgccgagtgtccgccactaggcaaagcaaaacactggcaaatcaaaagtttacctagtgccagacactaggcaaaaaaaaaacgctcggcaaatcggaagtttccctagtgccagacactagacaaagaaaaacacttgataaactagcgtcgtcagctaacaccatccaccaaccgttaacgttgccgagtatctgacttcgacactcggcaaagaaggtctctttgcctagtgtcggtctggaacactaggcaaagaggcactttacctagtgtcgtattttgacactcagtaaaataattttttttctttctgcttccaaactttttatgatgtgttcctatagcacctagaactacatgtcaagttttggtaaaatttttgaagtttttgctatatttacttaatttattttatttaattgaatttcttttgataattcaaatttgaactcggcaaggtaagaagcgagggtagcctggaaacacactttgcctagtgttacactcggtacaggagcctcccctgcctagtgctgcactcgacaaaagattcgcctttgcctagcgctgcactcggcacaggagtcgcctttgcctagtgctgcactaggcaaagcctccgttaccgtgccttccatcgtcggacccgaaagtagcaaacaacaggttcatgtgcactataaaaagacaaaattctcgagtttcatcttttattccacataagccttatattttccattttcatatgatttttagtttaagtttgtgtcttaactttttcgttaatacgtaattctatgcattatggatgcgtgaagtatttttgtttaaaaaaatgaaatgtcaaaatacgttttgtgatctatttccatgttttcacctaacaggtggtttttactatatattctgccataactctagccttagatgtaaatcgaaaaaaaatgagagatgagctggagatagccttagatgaagcgtctgaaatataaaagaaagagtaatgttgaacgcagtaggtgtagcagctgtagttccatctctaggaaagggaactgcaatccgggctccgggcctcgcgcaatctggcctgtcgtgtagatgcagccctgtccatgacggcccaagcaacgcccgcggctctcgatccaccacggaacccactccgacacacactgacacacacatgctggatgtggatgtgctgtccaattattagtagcaattcggtaggcacaggcacgtactggccggtgttttagctgtaagtaccgaaccaatcacggttaagaaccgattaatccgtgcccagccgccgagtgcgttcgtacgtgcatcggatgcactgcatgaattgagagcatcatcatatcatacgcaggagtagtacgacgccgctgctgtcttgtccggctaatgctttgctcacagattagtccatcgcccacggtcggtgtggtgtggatcgctgatgccactgctttttgtttggtttttattcccctgataatcctccgcgtccctgaatgtatctatttattttcattccgaaatccctttcacgaaaaagaaaacgaataaaaagagagttacgaatacgcttccggcggcccacatcaccttccagcgaacatcgcgccgcgctgacgtgtcgcccatcgcggccgtccatatcgccatccgacgaccgtggaagctggcagcggccgctccgttccgtcgaaggggcaggtcagtcaggtcacccacacggccacacccgcgcgggggatacgcggtggaaaacccggcgaccacatcaaaacacgaggcgtctcccgcaggactggtcactcggcacgcaggcagaggcagcacagcagcagccagctccatccatcctctttcccctcctcgcttcgcttcctcggcggattcctcctccctcggccgtccccgtccccttcttcgccgcgccagctcgcccgagttggtacgcccatcctctgctgtactccccccgttcctgctgtgcgaaaccgagcacccaaaccctagcctaagctattcgcatcgcaaactctattgagcgacggatcgcgaaacgcgcgccgccgcattcggacgagacctcgtggcccgtaccttcctactctaccgtcgtcgccggagaccagctcaccggttagggtttcgggattaggggcttggggcttggattcccgggggactccatacccggtggccttagaaggggaagggggcccagcggtggtggtggttcgactgtcagcgagcgagacggcggggcaccgccgatcgggcgtcgctggacatttgattgagctgggcaggcgaaggcgtggagcttgctcttcgattgggattagaggagggcggaggtggtatggtgggcggctcggctggctcaatggagccgctggccggtggtggggcaggcgagatcacgctctctcatagagcgtaatgggttgcgtaacacactcctgtttgtatttcgatccgatctaataattaaagtttatttacgtggtgcacatgtagaattttcccatgcccactgctaacttggattggatttttgccaaaaaaacgggtgtgcacccaatcacttatagtgaaaccgttgtgtgtttgatgtgcttctaaccaagtacaaatccagtgaaaacacacctaccattcaacaatccacattttggttgcaattatcagcattctagaaaggtgcatgtgcccattgatacacttgctattggtgcaggcaaacccaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtaggagctcgcatcatgatcatgcatcatggactcggcctactactgtggatttgtatgccattatagacttggtgctgtgaaagactgcttgatgatttgcgggtttgttgctgtgtaaaaaaaggtcccttggctcccagaagaccatgaaggttcggatctatcatgtaattccttgttatctgccaattatgtatggactatggacatgtgttgcgctgttcaacttactactacaaataagtaatcgatatgttcccttcccatgtctcggtgacaattgtctggagaagcttaggggtcgtttgtttgggattatgtctggagaaacttattttaaactaagtgtgagttcaagttaagttagattatataatctaggcagattataattccaagcgaacaggtccttagtgtttttggaaaatcctaggtgttcttttggctacattgttgtgtgtgcagatcccttgttggtctgtaagcgtggggaagtaagaatcgtccgtttctactgaagacctgctcgagttaggcaccgaggatgccggtaaccaaacagagcaatagtgtctctgtgggcacagtggagtgtgaatctgtgtgatgcaaatccgtcatttgtttagcaaaatttccagcgttgcatgatgcagtttctttaacacggacttaagggaagggaaaaaaatgttgagccaggagatccttcaatgtgttagactgacgtgatagccaactaaaccacgacgcaatgttgtcgttaatgacaaaaaaactatttgttcctaaatccttggcgacattgcatggctgtctcatgagataatggtctcatctcttatttatctcttatttatagccggaagtggtagtgacccctgcttgattgctcgtatgccatctcaagttctcaaccgtgtcgagcagccattttcccatctcaagcgcatcatcgtttcgtttgacctcatctgctatcctgctcctagtgcaaatcacatgcgacagaaagtgtgcggaccgcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcag

SEQ ID NO: 97 - DNA, 10671 bp, Artificial Sequence
  Expression cassette of construct 22807
  enhancer (165)..(256): eNOS
  promoter (301)..(2097): Ubi
  gene (2114)..(6283): Cas9
  misc_feature (6218)..(6274): NLS-TAG
  terminator (6289)..(6541): tNOS
  promoter (6548)..(6922): pU3
  misc_feature (6924)..(6941)
  misc_feature (6924)..(7026): sgRNA
  promoter (7037)..(9028): Ubi
  gene (9045)..(10223): PMI
  terminator (10246)..(10498): tNOS
cctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaacaaagcttggtaccattatgtggtctaggtaggttctatatataagaaaacttgaaatgttctaaaaaaaaattcaagcccatgcatgattgaagcaaacggtatagcaacggtgttaacctgatctagtgatctcttgcaatccttaacggccacctaccgcaggtagcaaacggcgtccccctcctcgatatctccgcggcgacctctggctttttccgcggaattgcgcggtggggacggattccacgagaccgcgacgcaaccgcctctcgccgctgggccccacaccgctcggtgccgtagcctcacgggactctttctccctcctcccccgttataaattggcttcatcccctccttgcctcatccatccaaatcccagtccccaatcccatcccttcgtaggagaaattcatcgaagctaagcgaatcctcgcgatcctctcaaggtactgcgagttttcgatccccctctcgacccctcgtatgtttgtgtttgtcgtagcgtttgattaggtatgctttccctgtttgtgttcgtcgtagcgtttgattaggtatgctttccctgttcgtgttcatcgtagtgtttgattaggtcgtgtgaggcgatggcctgctcgcgtccttcgatctgtagtcgatttgcgggtcgtggtgtagatctgcgggctgtgatgaagttatttggtgtgatctgctcgcctgattctgcgggttggctcgagtagatatgatggttggaccggttggttcgtttaccgcgctagggttgggctgggatgatgttgcatgcgccgttgcgcgtgatcccgcagcaggacttgcgtttgattgccagatctcgttacgattatgtgatttggtttggactttttagatctgtagcttctgcttatgtgccagatgcgcctactgctcatatgcctgatgataatcataaatggctgtggaactaactagttgattgcggagtcatgtatcagctacaggtgtagggactagctacaggtgtagggacttgcgtctaattgtttggtcctttactcatgttgcaattatgcaatttagtttagattgtttgttccactcatctaggctgtaaaagggacactgcttagattgctgtttaatctttttagtagattatattatattggtaacttattacccctattacatgccatacgtgacttctgctcatgcctgatgataatcatagatcactgtggaattaattagttgattgttgaatcatgtttcatgtacataccacggcacaattgcttagttccttaacaaatgcaaattttactgatccatgtatgatttgcgtggttctctaatgtgaaatactatagctacttgttagtaagaatcaggttcgtatgcttaatgctgtatgtgccttctgctcatgcctgatgataatcatatatcactggaattaattagttgatcgtttaatcatatatcaagtacataccatgccacaatttttagtcacttaacccatgcagattgaactggtccctgcatgttttgctaaattgttctattctgattagaccatatatcatgtatttttttttggtaatggttctcttattttaaatgctatatagttctggtacttgttagaaagatctgcttcatagtttagttgcctatccctcgaattaggatgctgagcagctgatcctatagctttgtttcatgtatcaattcttttgtgttcaacagtcagtttttgttagattcattgtaacttatggtcgcttactcttctggtcctcaatgcttgcaggatcgcggccgctcatatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggacccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgaagcttgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcttcgaagggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcagtcaacgtggagacaggggttttagagctagaaatagcaagttaaaataaggctagtccgttatcaacttgaaaaagtggcaccgagtcggtgctttttttttcggaccgcgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatccggcagcagccatgcagaagctgatcaacagcgtgcagaactacgcctggggcagcaagaccgccctgaccgagctgtacggcatggagaaccccagcagccagcccatggccgagctgtggatgggcgcccaccccaagagcagcagccgcgtgcagaacgccgccggcgacatcgtgagcctgcgcgacgtgatcgagagcgacaagagcaccctgctgggcgaggccgtggccaagcgcttcggcgagctgcccttcctgttcaaggtgctgtgcgccgcccagcccctgagcatccaggtgcaccccaacaagcacaacagcgagatcggcttcgccaaggagaacgccgccggcatccccatggacgccgccgagcgcaactacaaggaccccaaccacaagcccgagctggtgttcgccctgacccccttcctggccatgaacgccttccgcgagttcagcgagatcgtgagcctgctgcagcccgtggccggcgcccaccccgccatcgcccacttcctgcagcagcccgacgccgagcgcctgagcgagctgttcgccagcctgctgaacatgcagggcgaggagaagagccgcgccctggccatcctgaagagcgccctggacagccagcagggcgagccctggcagaccatccgcctgatcagcgagttctaccccgaggacagcggcctgttcagccccctgctgctgaacgtggtgaagctgaaccccggcgaggccatgttcctgttcgccgagaccccccacgcctacctgcagggcgtggccctggaggtgatggccaacagcgacaacgtgctgcgcgccggcctgacccccaagtacatcgacatccccgagctggtggccaacgtgaagttcgaggccaagcccgccaaccagctgctgacccagcccgtgaagcagggcgccgagctggacttccccatccccgtggacgacttcgccttcagcctgcacgacctgagcgacaaggagaccaccatcagccagcagagcgccgccatcctgttctgcgtggagggcgacgccaccctgtggaagggcagccagcagctgcagctgaagcccggcgagagcgccttcatcgccgccaacgagagccccgtgaccgtgaagggccacggccgcctggcccgcgtgtacaacaagctgtgataggagctcgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggcgcgccgcaattgaagtttgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcag

SEQ ID NO: 98 - DNA, 14475 bp, Artificial Sequence
  Expression cassette of construct 22808
  enhancer (165)..(256): eNOS
  promoter (301)..(2097): Ubi
  gene (2116)..(5190): TNFw
  terminator (2116)..(5190): tNOS
  promoter (5483)..(7475): Ubi
  gene (7489)..(10563): TNRv
  terminator (10570)..(10822): tNOS
  promoter (10841)..(12832): Ubi
  gene (12849)..(14027): PMI
  terminator (14050)..(14302): tNOS
cctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaacaaagcttggtaccattatgtggtctaggtaggttctatatataagaaaacttgaaatgttctaaaaaaaaattcaagcccatgcatgattgaagcaaacggtatagcaacggtgttaacctgatctagtgatctcttgcaatccttaacggccacctaccgcaggtagcaaacggcgtccccctcctcgatatctccgcggcgacctctggctttttccgcggaattgcgcggtggggacggattccacgagaccgcgacgcaaccgcctctcgccgctgggccccacaccgctcggtgccgtagcctcacgggactctttctccctcctcccccgttataaattggcttcatcccctccttgcctcatccatccaaatcccagtccccaatcccatcccttcgtaggagaaattcatcgaagctaagcgaatcctcgcgatcctctcaaggtactgcgagttttcgatccccctctcgacccctcgtatgtttgtgtttgtcgtagcgtttgattaggtatgctttccctgtttgtgttcgtcgtagcgtttgattaggtatgctttccctgttcgtgttcatcgtagtgtttgattaggtcgtgtgaggcgatggcctgctcgcgtccttcgatctgtagtcgatttgcgggtcgtggtgtagatctgcgggctgtgatgaagttatttggtgtgatctgctcgcctgattctgcgggttggctcgagtagatatgatggttggaccggttggttcgtttaccgcgctagggttgggctgggatgatgttgcatgcgccgttgcgcgtgatcccgcagcaggacttgcgtttgattgccagatctcgttacgattatgtgatttggtttggactttttagatctgtagcttctgcttatgtgccagatgcgcctactgctcatatgcctgatgataatcataaatggctgtggaactaactagttgattgcggagtcatgtatcagctacaggtgtagggactagctacaggtgtagggacttgcgtctaattgtttggtcctttactcatgttgcaattatgcaatttagtttagattgtttgttccactcatctaggctgtaaaagggacactgcttagattgctgtttaatctttttagtagattatattatattggtaacttattacccctattacatgccatacgtgacttctgctcatgcctgatgataatcatagatcactgtggaattaattagttgattgttgaatcatgtttcatgtacataccacggcacaattgcttagttccttaacaaatgcaaattttactgatccatgtatgatttgcgtggttctctaatgtgaaatactatagctacttgttagtaagaatcaggttcgtatgcttaatgctgtatgtgccttctgctcatgcctgatgataatcatatatcactggaattaattagttgatcgtttaatcatatatcaagtacataccatgccacaatttttagtcacttaacccatgcagattgaactggtccctgcatgttttgctaaattgttctattctgattagaccatatatcatgtatttttttttggtaatggttctcttattttaaatgctatatagttctggtacttgttagaaagatctgcttcatagtttagttgcctatccctcgaattaggatgctgagcagctgatcctatagctttgtttcatgtatcaattcttttgtgttcaacagtcagtttttgttagattcattgtaacttatggtcgcttactcttctggtcctcaatgcttgcaggatcgcggccgcgccaccatgggaaaacctattcctaatcctctgctgggcctggattctaccggaggcatggcccctaagaaaaagcggaaggtggacggcggagtggacctgagaacactgggatattctcagcagcagcaggagaagatcaagcccaaggtgagatctacagtggcccagcaccacgaagccctggtgggacacggatttacacacgcccacattgtggccctgtctcagcaccctgccgccctgggaacagtggccgtgaaatatcaggatatgattgccgccctgcctgaggccacacacgaagccattgtgggagtgggaaaacagtggtctggagccagagccctggaagccctgctgacagtggccggagaactgagaggacctcctctgcagctggatacaggacagctgctgaagattgccaaaaggggcggagtgaccgcggtggaagccgtgcacgcctggagaaatgccctgacaggagcccctctgaacctgacccccgaacaggtggtggccattgccagccacgacggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggactgacccccgaacaggtggtggccattgccagcaacaacggcggcaagcaggccctggaaaccgtgcagagactgctgcccgtgctgtgccaggcccatggcctgacacctgaacaggtggtggctatcgcctctaacaacggaggaaaacaggctctggaaacagtgcagcggctgctgcctgtgctgtgtcaggctcacggcttgactccagaacaggtggtggctattgcttccaacaacggggggaaacaggccctggaaactgtgcagcgcctgctgccagtgctgtgccaggctcacgggctgacccccgaacaggtggtggccattgccagcaacggcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggcctcactcccgaacaggtggtggccattgccagcaacatcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaacaacggggggaaacaggccctggaaactgtgcagcgcctgctgccagtgctgtgccaggctcacggactgacccccgaacaggtggtggccattgccagcaacggcggcggcaagcaggccctggaaaccgtgcagagactgctgcccgtgctgtgccaggcccatggcctgacacctgaacaggtggtggctatcgcctctaacaacggaggaaaacaagcactcgagacagtgcagcggctgctgcctgtgctgtgtcaggctcacggcttgactccagaacaggtggtggctattgcttccaacaacggggggaaacaggccctggaaactgtgcagcgcctgctgccagtgctgtgccaggctcacgggctgacccccgaacaggtggtggccattgccagcaacatcggcggcaagcaggccctggaaaccgtgcagagactgctgcccgtgctgtgccaggcccatggcctgacacctgaacaggtggtggctatcgcctctaacaacggaggaaaacaggctctggaaacagtgcagcggctgctgcctgtgctgtgtcaggctcacggcttgactccacagcaggtcgtggcaattgctagcaatatcggcggacggcccgccctggagagcattgtggcccagctgtctagacctgatcctgccctggccgccctgacaaatgatcacctggtggccctggcctgtctgggaggcagacctgccctggatgccgtgaaaaaaggactgcctcacgcccctgccctgattaaaagaacaaatagaagaatccccgagcggacctctcacagagtggccggatcccagctggtgaaatctgagctggaggagaagaagtctgagctgagacacaagctgaagtacgtgcctcacgagtacatcgagctgatcgagatcgccagaaatagcacccaggatagaatcctggagatgaaggtgatggagttcttcatgaaagtgtacggctacagaggaaagcatctgggaggaagcagaaaacctgacggagccatttatacagtgggcagccctatcgattatggcgtgatcgtggatacaaaggcctacagcggaggctacaatctgcctattggacaggccgatgagatgcagagatacgtggaggagaaccaaaccaggaacaagcatatcaaccctaacgagtggtggaaggtgtacccttctagcgtgaccgagttcaagttcctgtttgtgagcggccacttcaagggcaattataaggcccagctgaccaggctgaaccacatcacaaattgtaatggcgccgtgctgtctgtggaggaactgctgattggaggagagatgattaaggccggaacactgacactggaggaggtgagaagaaagttcaacaacggcgagatcaacttctgaaagcttgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcttcgaaccctagtcgaagacaaccggtgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagcggccgcgccaccatgggaaaacctattcctaatcctctgctgggcctggattctaccggaggcatggcccctaagaaaaagcggaaggtggacggcggagtggacctgagaacactgggatattctcagcagcagcaggagaagatcaagcccaaggtgagatctacagtggcccagcaccacgaagccctggtgggacacggatttacacacgcccacattgtggccctgtctcagcaccctgccgccctgggaacagtggccgtgaaatatcaggatatgattgccgccctgcctgaggccacacacgaagccattgtgggagtgggaaaacagtggtctggagccagagccctggaagccctgctgacagtggccggagaactgagaggacctcctctgcagctggatacaggacagctgctgaagattgccaaaaggggcggagtgaccgcggtggaagccgtgcacgcctggagaaatgccctgacaggagcccctctgaacctgacccccgaacaggtggtggccattgccagcaacaacggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacggactgacccccgaacaggtggtggccattgccagcaacggcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacgggctgacccccgaacaggtggtggccattgccagcaacggcggcggcaagcaggccctggaaaccgtgcagagactgctgcccgtgctgtgccaggcccatggcctgacacctgaacaggtggtggctatcgcctctaacggcggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacggcctcactcccgaacaggtggtggccattgccagcaacaacggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacggactgacccccgaacaggtggtggccattgccagcaacatcggcggcaagcaggccctggaaaccgtgcagagactgctgcccgtgctgtgccaggcccatggcctgacacctgaacaggtggtggctatcgcctctaacaacggaggaaaacaagcactcgagacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacgggctgacccccgaacaggtggtggccattgccagccacgacggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccacagcaggtcgtggcaattgctagccacgacggcggacggcccgccctggagagcattgtggcccagctgtctagacctgatcctgccctggccgccctgacaaatgatcacctggtggccctggcctgtctgggaggcagacctgccctggatgccgtgaaaaaaggactgcctcacgcccctgccctgattaaaagaacaaatagaagaatccccgagcggacctctcacagagtggccggatcccagctggtgaaatctgagctggaggagaagaagtctgagctgagacacaagctgaagtacgtgcctcacgagtacatcgagctgatcgagatcgccagaaatagcacccaggatagaatcctggagatgaaggtgatggagttcttcatgaaagtgtacggctacagaggaaagcatctgggaggaagcagaaaacctgacggagccatttatacagtgggcagccctatcgattatggcgtgatcgtggatacaaaggcctacagcggaggctacaatctgcctattggacaggccgatgagatgcagagatacgtggaggagaaccaaaccaggaacaagcatatcaaccctaacgagtggtggaaggtgtacccttctagcgtgaccgagttcaagttcctgtttgtgagcggccacttcaagggcaattataaggcccagctgaccaggctgaaccacatcacaaattgtaatggcgccgtgctgtctgtggaggaactgctgattggaggagagatgattaaggccggaacactgacactggaggaggtgagaagaaagttcaacaacggcgagatcaacttctgaaagcttgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcttcgaagacggaccgcgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatccggcagcagccatgcagaagctgatcaacagcgtgcagaactacgcctggggcagcaagaccgccctgaccgagctgtacggcatggagaaccccagcagccagcccatggccgagctgtggatgggcgcccaccccaagagcagcagccgcgtgcagaacgccgccggcgacatcgtgagcctgcgcgacgtgatcgagagcgacaagagcaccctgctgggcgaggccgtggccaagcgcttcggcgagctgcccttcctgttcaaggtgctgtgcgccgcccagcccctgagcatccaggtgcaccccaacaagcacaacagcgagatcggcttcgccaaggagaacgccgccggcatccccatggacgccgccgagcgcaactacaaggaccccaaccacaagcccgagctggtgttcgccctgacccccttcctggccatgaacgccttccgcgagttcagcgagatcgtgagcctgctgcagcccgtggccggcgcccaccccgccatcgcccacttcctgcagcagcccgacgccgagcgcctgagcgagctgttcgccagcctgctgaacatgcagggcgaggagaagagccgcgccctggccatcctgaagagcgccctggacagccagcagggcgagccctggcagaccatccgcctgatcagcgagttctaccccgaggacagcggcctgttcagccccctgctgctgaacgtggtgaagctgaaccccggcgaggccatgttcctgttcgccgagaccccccacgcctacctgcagggcgtggccctggaggtgatggccaacagcgacaacgtgctgcgcgccggcctgacccccaagtacatcgacatccccgagctggtggccaacgtgaagttcgaggccaagcccgccaaccagctgctgacccagcccgtgaagcagggcgccgagctggacttccccatccccgtggacgacttcgccttcagcctgcacgacctgagcgacaaggagaccaccatcagccagcagagcgccgccatcctgttctgcgtggagggcgacgccaccctgtggaagggcagccagcagctgcagctgaagcccggcgagagcgccttcatcgccgccaacgagagccccgtgaccgtgaagggccacggccgcctggcccgcgtgtacaacaagctgtgataggagctcgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggcgcgccgcaattgaagtttgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcag

SEQ ID NO: 99 - DNA, 10668 bp, Artificial Sequence
  Expression cassette of construct 22873
  enhancer (165)..(256): eNOS
  promoter (301)..(2097): Ubi
  gene (2114)..(6280): Cas9m
  misc_feature (6215)..(6271): NLS-TAG
  terminator (6286)..(6538): tNOS
  promoter (6545)..(6919): pU3
  misc_feature (6921)..(6938)
  misc_feature (6921)..(7023): sgRNA
  promoter (7034)..(9025): Ubi
  gene (9042)..(10220): PMI
  terminator (10243)..(10495): tNOS
cctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaacaaagcttggtaccattatgtggtctaggtaggttctatatataagaaaacttgaaatgttctaaaaaaaaattcaagcccatgcatgattgaagcaaacggtatagcaacggtgttaacctgatctagtgatctcttgcaatccttaacggccacctaccgcaggtagcaaacggcgtccccctcctcgatatctccgcggcgacctctggctttttccgcggaattgcgcggtggggacggattccacgagaccgcgacgcaaccgcctctcgccgctgggccccacaccgctcggtgccgtagcctcacgggactctttctccctcctcccccgttataaattggcttcatcccctccttgcctcatccatccaaatcccagtccccaatcccatcccttcgtaggagaaattcatcgaagctaagcgaatcctcgcgatcctctcaaggtactgcgagttttcgatccccctctcgacccctcgtatgtttgtgtttgtcgtagcgtttgattaggtatgctttccctgtttgtgttcgtcgtagcgtttgattaggtatgctttccctgttcgtgttcatcgtagtgtttgattaggtcgtgtgaggcgatggcctgctcgcgtccttcgatctgtagtcgatttgcgggtcgtggtgtagatctgcgggctgtgatgaagttatttggtgtgatctgctcgcctgattctgcgggttggctcgagtagatatgatggttggaccggttggttcgtttaccgcgctagggttgggctgggatgatgttgcatgcgccgttgcgcgtgatcccgcagcaggacttgcgtttgattgccagatctcgttacgattatgtgatttggtttggactttttagatctgtagcttctgcttatgtgccagatgcgcctactgctcatatgcctgatgataatcataaatggctgtggaactaactagttgattgcggagtcatgtatcagctacaggtgtagggactagctacaggtgtagggacttgcgtctaattgtttggtcctttactcatgttgcaattatgcaatttagtttagattgtttgttccactcatctaggctgtaaaagggacactgcttagattgctgtttaatctttttagtagattatattatattggtaacttattacccctattacatgccatacgtgacttctgctcatgcctgatgataatcatagatcactgtggaattaattagttgattgttgaatcatgtttcatgtacataccacggcacaattgcttagttccttaacaaatgcaaattttactgatccatgtatgatttgcgtggttctctaatgtgaaatactatagctacttgttagtaagaatcaggttcgtatgcttaatgctgtatgtgccttctgctcatgcctgatgataatcatatatcactggaattaattagttgatcgtttaatcatatatcaagtacataccatgccacaatttttagtcacttaacccatgcagattgaactggtccctgcatgttttgctaaattgttctattctgattagaccatatatcatgtatttttttttggtaatggttctcttattttaaatgctatatagttctggtacttgttagaaagatctgcttcatagtttagttgcctatccctcgaattaggatgctgagcagctgatcctatagctttgtttcatgtatcaattcttttgtgttcaacagtcagtttttgttagattcattgtaacttatggtcgcttactcttctggtcctcaatgcttgcaggatcgcggccgctaaaatggataagaagtactctattggcctcgatattggaaccaactctgtgggctgggccgtgatcaccgatgagtacaaggtgccatctaagaagttcaaggtgctcggcaacaccgataggcactctatcaagaagaacctcatcggtgccctcctcttcgattctggcgagaccgccgaggccaccaggctcaagaggaccgccaggaggaggtacaccaggaggaagaacaggatctgctacctccaggagatcttctctaacgagatggccaaggtggatgattctttcttccacaggctcgaggagtctttcctcgtggaggaggataagaagcacgagaggcacccaatcttcggcaacatcgtggatgaggtggcctaccacgagaagtacccaaccatctaccacctcaggaagaagctcgtggattctaccgataaggccgatctcaggctcatctacctcgccctcgcccacatgatcaagttcaggggccacttcctcatcgagggcgatctcaacccagataactctgatgtggataagctcttcatccagctcgtgcagacctacaaccagctcttcgaggagaacccaatcaacgcctctggcgtggatgccaaggccatcctctctgccaggctctctaagtctaggaggctcgagaacctcatcgcccagctcccaggcgagaagaagaacggcctcttcggcaacctcatcgccctctctctcggcctcaccccaaacttcaagtctaacttcgatctcgccgaggatgccaagctccagctctctaaggatacctacgatgatgatctcgataacctcctcgcccagatcggcgatcagtacgccgatctcttcctcgccgccaagaacctctctgatgccatcctcctctctgatatcctcagggtgaacaccgagatcaccaaggccccactctctgcctctatgatcaagaggtacgatgagcaccaccaggatctcaccctcctcaaggccctcgtgaggcagcagctcccagagaagtacaaggagatcttcttcgatcagtctaagaacggctacgccggctacatcgatggcggcgcctctcaggaggagttctacaagttcatcaagccaatcctcgagaagatggatggcaccgaggagctcctcgtgaagctcaacagggaggatctcctcaggaagcagaggaccttcgataacggctctatcccacaccagatccacctcggcgagctccacgccatcctcaggaggcaggaggatttctacccattcctcaaggataacagggagaagatcgagaagatcctcaccttccgcatcccatactacgtgggcccactcgccaggggcaactctaggttcgcctggatgaccaggaagtctgaggagaccatcaccccttggaacttcgaggaggtggtggataagggcgcctctgcccagtctttcatcgagaggatgaccaacttcgataagaacctcccaaacgagaaggtgctcccaaagcactctctcctctacgagtacttcaccgtgtacaacgagctcaccaaggtgaagtacgtgaccgagggcatgaggaagccagccttcctctctggcgagcagaagaaggccatcgtggatctcctcttcaagaccaacaggaaggtgaccgtgaagcagctcaaggaggattacttcaagaagatcgagtgcttcgattctgtggagatctctggcgtggaggataggttcaacgcctctctcggcacctaccacgatctcctcaagatcatcaaggataaggatttcctcgataacgaggagaacgaggatatcctcgaggatatcgtgctcaccctcaccctcttcgaggatagggagatgatcgaggagaggctcaagacctacgcccacctcttcgatgataaggtgatgaagcagctcaagaggaggaggtacaccggctggggcaggctctctaggaagctcatcaacggcatcagggataagcagtctggcaagaccatcctcgatttcctcaagtctgatggcttcgccaacaggaacttcatgcagctcatccacgatgattctctcaccttcaaggaggatatccagaaggctcaggtgtctggccagggccactctctccacgagcagatcgccaacctcgccggctctccagccatcaagaagggcatcctccagaccgtgaaggtggtggatgagctcgtgaaggtgatgggccacaagccagagaacatcgtgatcgagatggccagggagaaccagaccacccagaagggccagaagaactctagggagaggatgaagaggatcgaggagggcatcaaggagctcggctctcagatcctcaaggagcacccagtggagaacacccagctccagaacgagaagctctacctctactacctccagaacggcagggatatgtacgtggatcaggagctcgatatcaacaggctctctgattacgatgtggatcacatcgtgccacagtctttcctcaaggatgattctatcgataacaaggtgctcaccaggtctgataagaacaggggcaagtctgataacgtgccatctgaggaggtggttaagaagatgaagaactactggaggcagctcctcaacgccaagctcatcacccagaggaagttcgataacctcaccaaggccgagaggggcggcctctctgagctcgataaggccggcttcatcaagaggcagctcgtggagaccaggcagatcactaagcacgtggcccagatcctcgattctaggatgaacaccaagtacgatgagaacgataagctcatcagggaggtgaaggtgatcaccctcaagtctaagctcgtgtctgatttcaggaaggatttccagttctacaaggtgagggagatcaacaactaccaccacgcccacgatgcctacctcaacgccgtggtgggcaccgccctcatcaagaagtacccaaaactcgagtctgagttcgtgtacggcgattacaaggtgtacgatgtgaggaagatgatcgccaagtctgagcaggagatcggcaaggccaccgccaagtacttcttctactctaacatcatgaacttcttcaagaccgagatcaccctcgccaacggcgagatcaggaagaggccactcatcgagaccaacggcgagaccggcgagatcgtgtgggataagggcagggatttcgccaccgtgaggaaggtgctctctatgccacaggtgaacatcgtgaagaagaccgaggtgcagaccggcggcttctctaaggagtctatcctcccaaagaggaactctgataagctcatcgccaggaagaaggattgggacccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgaagcttgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcttcgaagggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcagtcaacgtggagacaggggttttagagctagaaatagcaagttaaaataaggctagtccgttatcaacttgaaaaagtggcaccgagtcggtgctttttttttcggaccgcgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatccggcagcagccatgcagaagctgatcaacagcgtgcagaactacgcctggggcagcaagaccgccctgaccgagctgtacggcatggagaaccccagcagccagcccatggccgagctgtggatgggcgcccaccccaagagcagcagccgcgtgcagaacgccgccggcgacatcgtgagcctgcgcgacgtgatcgagagcgacaagagcaccctgctgggcgaggccgtggccaagcgcttcggcgagctgcccttcctgttcaaggtgctgtgcgccgcccagcccctgagcatccaggtgcaccccaacaagcacaacagcgagatcggcttcgccaaggagaacgccgccggcatccccatggacgccgccgagcgcaactacaaggaccccaaccacaagcccgagctggtgttcgccctgacccccttcctggccatgaacgccttccgcgagttcagcgagatcgtgagcctgctgcagcccgtggccggcgcccaccccgccatcgcccacttcctgcagcagcccgacgccgagcgcctgagcgagctgttcgccagcctgctgaacatgcagggcgaggagaagagccgcgccctggccatcctgaagagcgccctggacagccagcagggcgagccctggcagaccatccgcctgatcagcgagttctaccccgaggacagcggcctgttcagccccctgctgctgaacgtggtgaagctgaaccccggcgaggccatgttcctgttcgccgagaccccccacgcctacctgcagggcgtggccctggaggtgatggccaacagcgacaacgtgctgcgcgccggcctgacccccaagtacatcgacatccccgagctggtggccaacgtgaagttcgaggccaagcccgccaaccagctgctgacccagcccgtgaagcagggcgccgagctggacttccccatccccgtggacgacttcgccttcagcctgcacgacctgagcgacaaggagaccaccatcagccagcagagcgccgccatcctgttctgcgtggagggcgacgccaccctgtggaagggcagccagcagctgcagctgaagcccggcgagagcgccttcatcgccgccaacgagagccccgtgaccgtgaagggccacggccgcctggcccgcgtgtacaacaagctgtgataggagctcgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggcgcgccgcaattgaagtttgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcag

SEQ ID NO: 100 - DNA, 10673 bp, Artificial Sequence
  Expression cassette of construct 23123
  enhancer (165)..(256): eNOS
  promoter (301)..(2097): Ubi
  gene (2114)..(6283): Cas9
  misc_feature (6218)..(6274): NLS-TAG
  terminator (6289)..(6541): tNOS
  promoter (6548)..(6922): pU3
  misc_feature (6924)..(6943)
  misc_feature (6924)..(7028): sgRNA
  promoter (7039)..(9030): Ubi
  gene (9047)..(10225): PMI
  terminator (10248)..(10500): tNOS
cctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaacaaagcttggtaccattatgtggtctaggtaggttctatatataagaaaacttgaaatgttctaaaaaaaaattcaagcccatgcatgattgaagcaaacggtatagcaacggtgttaacctgatctagtgatctcttgcaatccttaacggccacctaccgcaggtagcaaacggcgtccccctcctcgatatctccgcggcgacctctggctttttccgcggaattgcgcggtggggacggattccacgagaccgcgacgcaaccgcctctcgccgctgggccccacaccgctcggtgccgtagcctcacgggactctttctccctcctcccccgttataaattggcttcatcccctccttgcctcatccatccaaatcccagtccccaatcccatcccttcgtaggagaaattcatcgaagctaagcgaatcctcgcgatcctctcaaggtactgcgagttttcgatccccctctcgacccctcgtatgtttgtgtttgtcgtagcgtttgattaggtatgctttccctgtttgtgttcgtcgtagcgtttgattaggtatgctttccctgttcgtgttcatcgtagtgtttgattaggtcgtgtgaggcgatggcctgctcgcgtccttcgatctgtagtcgatttgcgggtcgtggtgtagatctgcgggctgtgatgaagttatttggtgtgatctgctcgcctgattctgcgggttggctcgagtagatatgatggttggaccggttggttcgtttaccgcgctagggttgggctgggatgatgttgcatgcgccgttgcgcgtgatcccgcagcaggacttgcgtttgattgccagatctcgttacgattatgtgatttggtttggactttttagatctgtagcttctgcttatgtgccagatgcgcctactgctcatatgcctgatgataatcataaatggctgtggaactaactagttgattgcggagtcatgtatcagctacaggtgtagggactagctacaggtgtagggacttgcgtctaattgtttggtcctttactcatgttgcaattatgcaatttagtttagattgtttgttccactcatctaggctgtaaaagggacactgcttagattgctgtttaatctttttagtagattatattatattggtaacttattacccctattacatgccatacgtgacttctgctcatgcctgatgataatcatagatcactgtggaattaattagttgattgttgaatcatgtttcatgtacataccacggcacaattgcttagttccttaacaaatgcaaattttactgatccatgtatgatttgcgtggttctctaatgtgaaatactatagctacttgttagtaagaatcaggttcgtatgcttaatgctgtatgtgccttctgctcatgcctgatgataatcatatatcactggaattaattagttgatcgtttaatcatatatcaagtacataccatgccacaatttttagtcacttaacccatgcagattgaactggtccctgcatgttttgctaaattgttctattctgattagaccatatatcatgtatttttttttggtaatggttctcttattttaaatgctatatagttctggtacttgttagaaagatctgcttcatagtttagttgcctatccctcgaattaggatgctgagcagctgatcctatagctttgtttcatgtatcaattcttttgtgttcaacagtcagtttttgttagattcattgtaacttatggtcgcttactcttctggtcctcaatgcttgcaggatcgcggccgctcatatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggacccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgaagcttgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcttcgaagggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcagggtcaacgtggagacaggggttttagagctagaaatagcaagttaaaataaggctagtccgttatcaacttgaaaaagtggcaccgagtcggtgctttttttttcggaccgcgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatccggcagcagccatgcagaagctgatcaacagcgtgcagaactacgcctggggcagcaagaccgccctgaccgagctgtacggcatggagaaccccagcagccagcccatggccgagctgtggatgggcgcccaccccaagagcagcagccgcgtgcagaacgccgccggcgacatcgtgagcctgcgcgacgtgatcgagagcgacaagagcaccctgctgggcgaggccgtggccaagcgcttcggcgagctgcccttcctgttcaaggtgctgtgcgccgcccagcccctgagcatccaggtgcaccccaacaagcacaacagcgagatcggcttcgccaaggagaacgccgccggcatccccatggacgccgccgagcgcaactacaaggaccccaaccacaagcccgagctggtgttcgccctgacccccttcctggccatgaacgccttccgcgagttcagcgagatcgtgagcctgctgcagcccgtggccggcgcccaccccgccatcgcccacttcctgcagcagcccgacgccgagcgcctgagcgagctgttcgccagcctgctgaacatgcagggcgaggagaagagccgcgccctggccatcctgaagagcgccctggacagccagcagggcgagccctggcagaccatccgcctgatcagcgagttctaccccgaggacagcggcctgttcagccccctgctgctgaacgtggtgaagctgaaccccggcgaggccatgttcctgttcgccgagaccccccacgcctacctgcagggcgtggccctggaggtgatggccaacagcgacaacgtgctgcgcgccggcctgacccccaagtacatcgacatccccgagctggtggccaacgtgaagttcgaggccaagcccgccaaccagctgctgacccagcccgtgaagcagggcgccgagctggacttccccatccccgtggacgacttcgccttcagcctgcacgacctgagcgacaaggagaccaccatcagccagcagagcgccgccatcctgttctgcgtggagggcgacgccaccctgtggaagggcagccagcagctgcagctgaagcccggcgagagcgccttcatcgccgccaacgagagccccgtgaccgtgaagggccacggccgcctggcccgcgtgtacaacaagctgtgataggagctcgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggcgcgccgcaattgaagtttgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcag

SEQ ID NO: 101 - DNA, 10693 bp, Artificial Sequence
  Expression cassette of construct 23501, gRNA target 1 dual guides
  promoter (214)..(734): 35S
  gene (748)..(4917): Cas9
  misc_feature (4852)..(4908): NLS-TAG
  terminator (4923)..(5175): tNOS
  promoter (5196)..(5570): pU3
  misc_feature (5572)..(5591)
  misc_feature (5592)..(5636): crRNA
  promoter (5643)..(6158): pU6
  misc_feature (6159)..(6246): tracrRNA
  promoter (6253)..(8245): Ubi
  gene (8257)..(9435): PMI
  terminator (9440)..(10474): Ubi
cctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccgagtcaaagattcaaatagaggacctaacagaactcgccgtaaagactggcgaacagttcatacagagtctcttacgactcaatgacaagaagaaaatcttcgtcaacttggtggagcacgacacgctagtctactccaaaaatatcaaagatacagtctcagaagaccaaagggcaattgagacttttcaacaaagggtaatatccggaaacctcctcggattccattgcccagctatctgtcacttaattgtgaagatagtggaaaaggaaggtggctcctacaaatgccatcattgcgataaaggaaaggccatcgttgaagatgcctctgccgacagtggtcccaaagatggacccccacccacgaggagcatcgtggtaaaagaagacgttccaaccacgtcttcaaagcaagtggattgatgtgatatctccactgacgtaagggatgacgcacaatcccactatccttcgcaagacccttcctctatataaggaagttcatttcatttggagaggataattatccaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgaagcttgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaccggaattcgggacccgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcatgcagtcgaagtaatcggcggttttagagctatgctgttttgaatggtcccaaaactttttttttactagttttgtgaaagttgaattacggcatagccgaaggaataacagaatcgtttcacactttcgtaacaaaggtcttcttatcatgtttcagacgatggaggcaaggctgatcaaagtgatcaagcacataaacgcatttttttaccatgtttcactccataagcgtctgagattatcacaagtcacgtctagtagtttgatggtacactagtgacaatcagttcgtgcagacagagctcatacttgactacttgagcgattacaggcgaaagtgtgaaacgcatgtgatgtgggctgggaggaggagaatatatactaatgggccgtatcctgatttgggctgcgtcggaaggtgcagcccacgcgcgccgtaccgcgcgggtggcgctgctacccactttagtccgttggatggggatccgatggtttgcgcggtggcgttgcgggggatgtttagtaccacatcggaaaccgaaagacgatggaaccagcttataaacccgcgcgctgtagtcagcttggaaccattcaaaacagcatagcaagttaaaataaggctagtccgttatcaacttgaaaaagtggcaccgagtcggtgctttttttttcctaggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagtgactaaatagatgcagaagctgatcaacagcgtgcagaactacgcctggggcagcaagaccgccctgaccgagctgtacggcatggagaaccccagcagccagcccatggccgagctgtggatgggcgcccaccccaagagctcaagccgcgtgcagaacgccgccggcgatatcgttagcctgcgcgacgtgatcgagagcgacaagagcaccctgctgggcgaggccgtggccaagcgcttcggcgagctgcccttcctgttcaaggtgctgtgcgccgctcagcccctgagcatccaggtgcaccctaacaagcacaacagcgagatcggcttcgccaaggagaacgccgccggcatccccatggacgccgccgagcgcaactacaaggaccccaaccacaagcccgagctggtgttcgccctgacccccttcctggccatgaacgccttccgcgagttcagcgagatcgttagcctgctgcagcccgtggccggcgcccaccccgctatcgcccacttccttcagcagcccgacgccgagcgcctgagcgagctgttcgccagcctgctgaacatgcagggtgaggagaagtcacgcgccctggccatcctgaagagcgccctggacagccagcagggcgagccctggcagacaatccgcctgatcagcgagttctaccccgaggatagcggcctgttcagccccctgctgctgaacgtggtgaagctgaaccccggcgaggccatgttcctgttcgccgagaccccccacgcctacctgcagggcgtggccctggaggtgatggccaacagcgacaacgtgctgcgcgccggcctgacccccaagtacatcgacatccccgagctggtggccaacgtgaagttcgaggctaagcccgccaaccagctgctgacccagcccgtgaagcagggcgccgagctggacttccctatccccgttgacgacttcgccttcagcctgcacgacctgagcgacaaggagaccactatcagccagcagagcgccgcgatcctgttctgcgtggagggcgacgccaccctgtggaagggcagccagcagctgcagctgaagcccggcgagagcgcctttatcgccgccaacgagagccccgtgaccgtgaagggccacggccgcctggcccgcgtgtacaacaagctgtgatagctacgtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctgcaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcggaccgcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcag

SEQ ID NO: 102 - DNA, 10264 bp, Artificial Sequence
  Expression cassette of construct 23501, gRNA target 1 single guide
  promoter (214)..(734): 35S
  gene (748)..(4917): Cas9
  misc_feature (4852)..(4908): NLS-TAG
  terminator (4923)..(5175): tNOS
  promoter (5196)..(5711): pU6
  misc_feature (5712)..(5817): sgRNA
  misc_feature (5713)..(5732)
  promoter (5824)..(7816): Ubi promoter
  gene (7828)..(9006): PMI
  terminator (9011)..(10045): Ubi terminator
cctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccgagtcaaagattcaaatagaggacctaacagaactcgccgtaaagactggcgaacagttcatacagagtctcttacgactcaatgacaagaagaaaatcttcgtcaacttggtggagcacgacacgctagtctactccaaaaatatcaaagatacagtctcagaagaccaaagggcaattgagacttttcaacaaagggtaatatccggaaacctcctcggattccattgcccagctatctgtcacttaattgtgaagatagtggaaaaggaaggtggctcctacaaatgccatcattgcgataaaggaaaggccatcgttgaagatgcctctgccgacagtggtcccaaagatggacccccacccacgaggagcatcgtggtaaaagaagacgttccaaccacgtcttcaaagcaagtggattgatgtgatatctccactgacgtaagggatgacgcacaatcccactatccttcgcaagacccttcctctatataaggaagttcatttcatttggagaggataattatccaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgaagcttgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaccggaattcgggaccctttgtgaaagttgaattacggcatagccgaaggaataacagaatcgtttcacactttcgtaacaaaggtcttcttatcatgtttcagacgatggaggcaaggctgatcaaagtgatcaagcacataaacgcatttttttaccatgtttcactccataagcgtctgagattatcacaagtcacgtctagtagtttgatggtacactagtgacaatcagttcgtgcagacagagctcatacttgactacttgagcgattacaggcgaaagtgtgaaacgcatgtgatgtgggctgggaggaggagaatatatactaatgggccgtatcctgatttgggctgcgtcggaaggtgcagcccacgcgcgccgtaccgcgcgggtggcgctgctacccactttagtccgttggatggggatccgatggtttgcgcggtggcgttgcgggggatgtttagtaccacatcggaaaccgaaagacgatggaaccagcttataaacccgcgcgctgtagtcagcttgtgcagtcgaagtaatcggcggttttagagctagaaatagcaagttaaaataaggctagtccgttatcaacttgaaaaagtggcaccgagtcggtgctttttttttcctaggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagtgactaaatagatgcagaagctgatcaacagcgtgcagaactacgcctggggcagcaagaccgccctgaccgagctgtacggcatggagaaccccagcagccagcccatggccgagctgtggatgggcgcccaccccaagagctcaagccgcgtgcagaacgccgccggcgatatcgttagcctgcgcgacgtgatcgagagcgacaagagcaccctgctgggcgaggccgtggccaagcgcttcggcgagctgcccttcctgttcaaggtgctgtgcgccgctcagcccctgagcatccaggtgcaccctaacaagcacaacagcgagatcggcttcgccaaggagaacgccgccggcatccccatggacgccgccgagcgcaactacaaggaccccaaccacaagcccgagctggtgttcgccctgacccccttcctggccatgaacgccttccgcgagttcagcgagatcgttagcctgctgcagcccgtggccggcgcccaccccgctatcgcccacttccttcagcagcccgacgccgagcgcctgagcgagctgttcgccagcctgctgaacatgcagggtgaggagaagtcacgcgccctggccatcctgaagagcgccctggacagccagcagggcgagccctggcagacaatccgcctgatcagcgagttctaccccgaggatagcggcctgttcagccccctgctgctgaacgtggtgaagctgaaccccggcgaggccatgttcctgttcgccgagaccccccacgcctacctgcagggcgtggccctggaggtgatggccaacagcgacaacgtgctgcgcgccggcctgacccccaagtacatcgacatccccgagctggtggccaacgtgaagttcgaggctaagcccgccaaccagctgctgacccagcccgtgaagcagggcgccgagctggacttccctatccccgttgacgacttcgccttcagcctgcacgacctgagcgacaaggagaccactatcagccagcagagcgccgcgatcctgttctgcgtggagggcgacgccaccctgtggaagggcagccagcagctgcagctgaagcccggcgagagcgcctttatcgccgccaacgagagccccgtgaccgtgaagggccacggccgcctggcccgcgtgtacaacaagctgtgatagctacgtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctgcaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcggaccgcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcag

SEQ ID NO: 103 - DNA, 10692 bp, Artificial Sequence
  Expression cassette of construct 23501, gRNA target 2 dual guides
  promoter (214)..(734): 35S
  gene (748)..(4917): Cas9
  misc_feature (4852)..(4908): NLS-TAG
  terminator (4923)..(5175): tNOS
  promoter (5196)..(5570): pU3
  misc_feature (5572)..(5590)
  misc_feature (5591)..(5635): crRNA
  promoter (5642)..(6157): pU6
  misc_feature (6158)..(6245): tracrRNA
  promoter (6252)..(8244): Ubi promoter
  gene (8256)..(9434): PMI
  terminator (9439)..(10473): Ubi terminator
cctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccgagtcaaagattcaaatagaggacctaacagaactcgccgtaaagactggcgaacagttcatacagagtctcttacgactcaatgacaagaagaaaatcttcgtcaacttggtggagcacgacacgctagtctactccaaaaatatcaaagatacagtctcagaagaccaaagggcaattgagacttttcaacaaagggtaatatccggaaacctcctcggattccattgcccagctatctgtcacttaattgtgaagatagtggaaaaggaaggtggctcctacaaatgccatcattgcgataaaggaaaggccatcgttgaagatgcctctgccgacagtggtcccaaagatggacccccacccacgaggagcatcgtggtaaaagaagacgttccaaccacgtcttcaaagcaagtggattgatgtgatatctccactgacgtaagggatgacgcacaatcccactatccttcgcaagacccttcctctatataaggaagttcatttcatttggagaggataattatccaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgaagcttgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaccggaattcgggacccgggatctttaaacatacgaacagatcacttaaagttcttctgaagcaacttaaagttatcaggcatgcatggatcttggaggaatcagatgtgcagtcagggaccatagcacaggacaggcgtcttctactggtgctaccagcaaatgctggaagccgggaacactgggtacgttggaaaccacgtgatgtggagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctggtttaaaagagttgtgcagatgatccgtggcagagaccggcaggtacgtcggttttagagctatgctgttttgaatggtcccaaaactttttttttactagttttgtgaaagttgaattacggcatagccgaaggaataacagaatcgtttcacactttcgtaacaaaggtcttcttatcatgtttcagacgatggaggcaaggctgatcaaagtgatcaagcacataaacgcatttttttaccatgtttcactccataagcgtctgagattatcacaagtcacgtctagtagtttgatggtacactagtgacaatcagttcgtgcagacagagctcatacttgactacttgagcgattacaggcgaaagtgtgaaacgcatgtgatgtgggctgggaggaggagaatatatactaatgggccgtatcctgatttgggctgcgtcggaaggtgcagcccacgcgcgccgtaccgcgcgggtggcgctgctacccactttagtccgttggatggggatccgatggtttgcgcggtggcgttgcgggggatgtttagtaccacatcggaaaccgaaagacgatggaaccagcttataaacccgcgcgctgtagtcagcttggaaccattcaaaacagcatagcaagttaaaataaggctagtccgttatcaacttgaaaaagtggcaccgagtcggtgctttttttttcctaggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagtgactaaatagatgcagaagctgatcaacagcgtgcagaactacgcctggggcagcaagaccgccctgaccgagctgtacggcatggagaaccccagcagccagcccatggccgagctgtggatgggcgcccaccccaagagctcaagccgcgtgcagaacgccgccggcgatatcgttagcctgcgcgacgtgatcgagagcgacaagagcaccctgctgggcgaggccgtggccaagcgcttcggcgagctgcccttcctgttcaaggtgctgtgcgccgctcagcccctgagcatccaggtgcaccctaacaagcacaacagcgagatcggcttcgccaaggagaacgccgccggcatccccatggacgccgccgagcgcaactacaaggaccccaaccacaagcccgagctggtgttcgccctgacccccttcctggccatgaacgccttccgcgagttcagcgagatcgttagcctgctgcagcccgtggccggcgcccaccccgctatcgcccacttccttcagcagcccgacgccgagcgcctgagcgagctgttcgccagcctgctgaacatgcagggtgaggagaagtcacgcgccctggccatcctgaagagcgccctggacagccagcagggcgagccctggcagacaatccgcctgatcagcgagttctaccccgaggatagcggcctgttcagccccctgctgctgaacgtggtgaagctgaaccccggcgaggccatgttcctgttcgccgagaccccccacgcctacctgcagggcgtggccctggaggtgatggccaacagcgacaacgtgctgcgcgccggcctgacccccaagtacatcgacatccccgagctggtggccaacgtgaagttcgaggctaagcccgccaaccagctgctgacccagcccgtgaagcagggcgccgagctggacttccctatccccgttgacgacttcgccttcagcctgcacgacctgagcgacaaggagaccactatcagccagcagagcgccgcgatcctgttctgcgtggagggcgacgccaccctgtggaagggcagccagcagctgcagctgaagcccggcgagagcgcctttatcgccgccaacgagagccccgtgaccgtgaagggccacggccgcctggcccgcgtgtacaacaagctgtgatagctacgtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctgcaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcggaccgcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcag

SEQ ID NO: 104 - DNA, 10262 bp, Artificial Sequence
  Expression cassette of construct 23501, gRNA target 2 single guide
  promoter (214)..(734): 35S promoter
  gene (748)..(4917): Cas9
  terminator (4923)..(5175): tNOS
  promoter (5196)..(5711)
  misc_feature (5712)..(5730)
  misc_feature (5712)..(5815): sgRNA
  promoter (5822)..(7814): Ubi promoter
  gene (7826)..(9004): PMI
  terminator (9009)..(10043): Ubi terminator
cctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccgagtcaaagattcaaatagaggacctaacagaactcgccgtaaagactggcgaacagttcatacagagtctcttacgactcaatgacaagaagaaaatcttcgtcaacttggtggagcacgacacgctagtctactccaaaaatatcaaagatacagtctcagaagaccaaagggcaattgagacttttcaacaaagggtaatatccggaaacctcctcggattccattgcccagctatctgtcacttaattgtgaagatagtggaaaaggaaggtggctcctacaaatgccatcattgcgataaaggaaaggccatcgttgaagatgcctctgccgacagtggtcccaaagatggacccccacccacgaggagcatcgtggtaaaagaagacgttccaaccacgtcttcaaagcaagtggattgatgtgatatctccactgacgtaagggatgacgcacaatcccactatccttcgcaagacccttcctctatataaggaagttcatttcatttggagaggataattatccaccatggacaagaagtacagcatcggcctggacatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtgaagcttgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaccggaattcgggaccctttgtgaaagttgaattacggcatagccgaaggaataacagaatcgtttcacactttcgtaacaaaggtcttcttatcatgtttcagacgatggaggcaaggctgatcaaagtgatcaagcacataaacgcatttttttaccatgtttcactccataagcgtctgagattatcacaagtcacgtctagtagtttgatggtacactagtgacaatcagttcgtgcagacagagctcatacttgactacttgagcgattacaggcgaaagtgtgaaacgcatgtgatgtgggctgggaggaggagaatatatactaatgggccgtatcctgatttgggctgcgtcggaaggtgcagcccacgcgcgccgtaccgcgcgggtggcgctgctacccactttagtccgttggatggggatccgatggtttgcgcggtggcgttgcgggggatgtttagtaccacatcggaaaccgaaagacgatggaaccagcttataaacccgcgcgctgtagtcagcttgagaccggcaggtacgtcggttttagagctagaaatagcaagttaaaataaggctagtccgttatcaacttgaaaaagtggcaccgagtcggtgctttttttttcctaggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagtgactaaatagatgcagaagctgatcaacagcgtgcagaactacgcctggggcagcaagaccgccctgaccgagctgtacggcatggagaaccccagcagccagcccatggccgagctgtggatgggcgcccaccccaagagctcaagccgcgtgcagaacgccgccggcgatatcgttagcctgcgcgacgtgatcgagagcgacaagagcaccctgctgggcgaggccgtggccaagcgcttcggcgagctgcccttcctgttcaaggtgctgtgcgccgctcagcccctgagcatccaggtgcaccctaacaagcacaacagcgagatcggcttcgccaaggagaacgccgccggcatccccatggacgccgccgagcgcaactacaaggaccccaaccacaagcccgagctggtgttcgccctgacccccttcctggccatgaacgccttccgcgagttcagcgagatcgttagcctgctgcagcccgtggccggcgcccaccccgctatcgcccacttccttcagcagcccgacgccgagcgcctgagcgagctgttcgccagcctgctgaacatgcagggtgaggagaagtcacgcgccctggccatcctgaagagcgccctggacagccagcagggcgagccctggcagacaatccgcctgatcagcgagttctaccccgaggatagcggcctgttcagccccctgctgctgaacgtggtgaagctgaaccccggcgaggccatgttcctgttcgccgagaccccccacgcctacctgcagggcgtggccctggaggtgatggccaacagcgacaacgtgctgcgcgccggcctgacccccaagtacatcgacatccccgagctggtggccaacgtgaagttcgaggctaagcccgccaaccagctgctgacccagcccgtgaagcagggcgccgagctggacttccctatccccgttgacgacttcgccttcagcctgcacgacctgagcgacaaggagaccactatcagccagcagagcgccgcgatcctgttctgcgtggagggcgacgccaccctgtggaagggcagccagcagctgcagctgaagcccggcgagagcgcctttatcgccgccaacgagagccccgtgaccgtgaagggccacggccgcctggcccgcgtgtacaacaagctgtgatagctacgtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctgcaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgataagtgatccaggttattactatgttagctaggttttttttacaaggataaattatctgtgatcataattcttatgaaagctttatgtttcctggaggcagtggcatgcaatgcatgacagcaacttgatcacaccagctgaggtagatacggtaacaaggttcttaaatctgttcaccaaatcattggagaacacacatacacattcttgccagtcttggttagagaaatttcatgacaaaatgccaaagctgtcttgactcttcacttttggccatgagtcgtgacttagtttggtttaatggaccggttctcctagcttgttctactcaaaactgttgttgatgcgaataagttgtgatggttgatctctggattttgttttgctctcaatagtggacgagattagatagcggaccgcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcag

SEQ ID NO: 105 - DNA, 1366 bp, Artificial Sequence
  TALEN-induced mutation in Event 38A ID 22808-4108 allele 2
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacaggacgaaccggtgactggcgaaggaagcaatgccgatgccctcggtgggctcgctaggcagctctccgaggagaggagaacaaggctcgcgcgccgcgtctctgccatcaacccaagaggctctagatgtgcgtcgtacgatatctaagacaagtggctttactgtcagtcacatgcttgtaaataagtagactttattttaataaaacataaaaatatatat

SEQ ID NO: 106 - DNA, 1366 bp, Artificial Sequence; identical to SEQ ID NO: 73
  CRISPR-induced MTL mutation in Event 27A ID 22807-4073 allele 2

SEQ ID NO: 107 - DNA, 1363 bp, Artificial Sequence; identical to SEQ ID NO: 76
  CRISPR-induced MTL mutation in Event 27A ID 22807-4081 allele 2

SEQ ID NO: 108 - DNA, 1371 bp, Zea mays
agttcatcactaatcacacttattgttccctcgacgagtatctagctagctcattaatcgatcaatcggggtgtgcggtcgaaggcggcaatggcgagctactcgtcgcggcgtccatgcaatacctatagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggagaacaaggctcgcgcgccgcgtgtctgccatcaacccaagaggctctagatgtgcgtcgtacgatatctaagacaagtggctttactgtcagtcacatgcttgtaaataagtagactttattttaataaaacataaaaatatatat

SEQ ID NO: 109 - DNA, 1371 bp, Zea mays
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagctcgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggagaacaaggctcgcgcgccgcgtgtctgccatcaacccaagaggctctagatgtgcgtcgtacgatatctaagacaagtggctttactgtcagtcacatgcttgtaaataagtagactttattttaataaaacataaaaatatatat

SEQ ID NO: 110 - DNA, 1371 bp, Zea mays
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcctgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggagaacaaggctcgcgcgccgcgtgtctgccatcaacccaagaggctctagatgtgcgtcgtacgatatctaagacaagtggctttactgtcagtcacatgcttgtaaataagtagactttattttaataaaacataaaaatatatat

SEQ ID NO: 111 - DNA, 1371 bp, Zea mays
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttacgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggagaacaaggctcgcgcgccgcgtgtctgccatcaacccaagaggctctagatgtgcgtcgtacgatatctaagacaagtggctttactgtcagtcacatgcttgtaaataagtagactttattttaataaaacataaaaatatatat

SEQ ID NO: 112 - DNA, 1371 bp, Zea mays
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatacggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggagaacaaggctcgcgcgccgcgtgtctgccatcaacccaagaggctctagatgtgcgtcgtacgatatctaagacaagtggctttactgtcagtcacatgcttgtaaataagtagactttattttaataaaacataaaaatatatat

SEQ ID NO: 113 - DNA, 1371 bp, Zea mays
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgattggcgaaggaagcaatgccgatgccctcggtgggctcgctaggcagctctccgaggagaggagaacaaggctcgcgcgccgcgtgtctgccatcaacccaagaggctctagatgtgcgtcgtacgatatctaagacaagtggctttactgtcagtcacatgcttgtaaataagtagactttattttaataaaacataaaaatatatat

SEQ ID NO: 114 - DNA, 1371 bp, Zea mays
agttcatcactaatcacacttattgttccctcgacgagtatctagctagctcattaatcgatcaatcggggtgtgcggtcgaaggcggcaatggcgagctactcgtcgcggcgtccatgcaatacctgtagcacgaaggcgatggccgggagcgtggtcggcgagcccgtcgtgctggggcagagggtgacggtgctgacggtggacggcggcggcgtccggggtctcatcccgggaaccatcctcgccttcctcgaggccaggctgcaggagctggacggaccggaggcgaggctggcggactacttcgactacatcgccggaaccagcaccggcggtctcatcaccgccatgctcaccgcgcccggcaaggacaagcggcctctctacgctgccaaggacatcaaccacttttacatggagaactgcccgcgcatcttccctcagaagagcaggcttgcggccgccatgtccgcgctgaggaagccaaagtacaacggcaagtgcatgcgcagcctgattaggagcatcctcggcgagacgagggccaagagcacgcctctgaagaacgctctgctctcggacgtgtgcattggcacgtccgccgcgccgacctacctcccggcgcactacttccagactgaagacgccaacggcaaggagcgcgaatacaacctcatcgacggcggtgtggcggccaacaacccgacgatggttgcgatgacgcagatcaccaaaaagatgcttgccagcaaggacaaggccgaggagctgtacccagtgaagccgtcgaactgccgcaggttcctggtgctgtccatcgggacggggtcgacgtccgagcagggcctctacacggcgcggcagtgctcccggtggggtatctgccggtggctccgcaacaacggcatggcccccatcatcgacatcttcatggcggccagctcggacctggtggacatccacgtcgccgcgatgttccagtcgctccacagcgacggcgactacctgcgcatccaggacaactcgctccgtggcgccgcggccaccgtggacgcggcgacgccggagaacatgcggacgctcgtcgggatcggggagcggatgctggcacagagggtgtccagggtcaacgtggagacagggaggtacgaaccggtgactggcgaaggaagcaatgccgatgccctcggtgggctcgctaggcagctctccgaggagaggaaaacaaggctcgcgcgccgcgtgtctgccatcaacccaagaggctctagatgtgcgtcgtacgatatctaagacaagtggctttactgtcagtcacatgcttgtaaataagtagactttattttaataaaacataaaaatatatat

SEQ ID NO: 115 - protein, 401 aa, Zea mays
MASYSSRRPCNTYSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMENCPRIFPQKSRLAAAMSALRKPKYNGKCMRSLIRSILGETRAKSTPLKNALLSDVCIGTSAAPTYLPAHYFQTEDANGKEREYNLIDGGVAANNPTMVAMTQITKKMLASKDKAEELYPVKPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGRYEPVTGEGSNADALGGLARQLSEERRTRLARRVSAINPRGSRCASYDI

SEQ ID NO: 116 - protein, 401 aa, Zea mays
MASYSSRRPCNTCSTKAMAGSVVGELVVLGQRVTVLTVDGGGVRGLIPGTILAFLEARLQELDGPEARLADYFDYIAGTSTGGLITAMLTAPGKDKRPLYAAKDINHFYMENCPRIFPQKSRLAAAMSALRKPKYNGKCMRSLIRSILGETRAKSTPLKNALLSDVCIGTSAAPTYLPAHYFQTEDANGKEREYNLIDGGVAANNPTMVAMTQITKKMLASKDKAEELYPVKPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGRYEPVTGEGSNADALGGLARQLSEERRTRLARRVSAINPRGSRCASYDI

SEQ ID NO: 117 - protein, 401 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMENCLRIFPQKSRLAAAMSALRKPKYNGKCMRSLIRSILGETRAKSTPLKNALLSDVCIGTSAAPTYLPAHYFQTEDANGKEREYNLIDGGVAANNPTMVAMTQITKKMLASKDKAEELYPVKPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGRYEPVTGEGSNADALGGLARQLSEERRTRLARRVSAINPRGSRCASYDI

SEQ ID NO: 118 - protein, 401 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMENCPRIFPQKSRLAAAMSALRKPKYNGKCMRSLIRSILGETRAKSTPLKNALLSDVCIGTSAAPTYLPAHYFQTEDANGKEREYNLIDGGVAANNPTMVTMTQITKKMLASKDKAEELYPVKPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGRYEPVTGEGSNADALGGLARQLSEERRTRLARRVSAINPRGSRCASYDI

SEQ ID NO: 119 - protein, 401 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMENCPRIFPQKSRLAAAMSALRKPKYNGKCMRSLIRSILGETRAKSTPLKNALLSDVCIGTSAAPTYLPAHYFQTEDANGKEREYNLIDGGVAANNPTMVAMTQITKKMLASKDKAEELYPVKPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENIRTLVGIGERMLAQRVSRVNVETGRYEPVTGEGSNADALGGLARQLSEERRTRLARRVSAINPRGSRCASYDI

SEQ ID NO: 120 - protein, 401 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMENCPRIFPQKSRLAAAMSALRKPKYNGKCMRSLIRSILGETRAKSTPLKNALLSDVCIGTSAAPTYLPAHYFQTEDANGKEREYNLIDGGVAANNPTMVAMTQITKKMLASKDKAEELYPVKPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGRYEPVIGEGSNADALGGLARQLSEERRTRLARRVSAINPRGSRCASYDI

SEQ ID NO: 121 - protein, 401 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMENCPRIFPQKSRLAAAMSALRKPKYNGKCMRSLIRSILGETRAKSTPLKNALLSDVCIGTSAAPTYLPAHYFQTEDANGKEREYNLIDGGVAANNPTMVAMTQITKKMLASKDKAEELYPVKPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGRYEPVTGEGSNADALGGLARQLSEERKTRLARRVSAINPRGSRCASYDI

SEQ ID NO: 122 - protein, 379 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMQNCPRIFPQKSRLAAAMSALRKPKYNGKCMRSLIRSILGETRVSETLTNVIIPAFDIRLLQPIIFSTYDAKSTPLKNALLSDVCIGTSAAPTYLPAHYFQTEDANGKEREYNLIDGGVAANNPTMVAMTQITKKMLASKDKAEELYPVNPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVENR

SEQ ID NO: 123 - protein, 396 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMQNCPRIFPQKSRLAAAMSALRKPKYNGKCMRSLIRSILGETRVSETLTNVIIPAFDIRLLQPIIFSTYDAKSTPLKNALLSDVCIGTSAAPTYLPAHYFQTEDANGKEREYNLIDGGVAANNPTMVAMTQITKKMLASKDKAEELYPVNPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGRTGDWRRKQCRCPRWAR

SEQ ID NO: 124 - protein, 379 aa, Zea mays; identical to SEQ ID NO: 122

SEQ ID NO: 125 - protein, 394 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMQNCPRIFPQKSRLAAAMSALRKPKYNGKCMRSLIRSILGETRVSETLTNVIIPAFDIRLLQPIIFSTYDAKSTPLKNALLSDVCIGTSAAPTYLPAHYFQTEDANGKEREYNLIDGGVAANNPTMVAMTQITKKMLASKDKAEELYPVNPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETTGDWRRKQCRCPRWAR

SEQ ID NO: 126 - protein, 395 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMQNCPRIFPQKSRLAAAMSALRKPKYNGKCMRSLIRSILGETRVSETLTNVIIPAFDIRLLQPIIFSTYDAKSTPLKNALLSDVCIGTSAAPTYLPAHYFQTEDANGKEREYNLIDGGVAANNPTMVAMTQITKKMLASKDKAEELYPVNPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGTGDWRRKQCRCPRWAR

SEQ ID NO: 127 - protein, 393 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMQNCPRIFPQKSRLAAAMSALRKPKYNGKCMRSLIRSILGETRVSETLTNVIIPAFDIRLLQPIIFSTYDAKSTPLKNALLSDVCIGTSAAPTYLPAHYFQTEDANGKEREYNLIDGGVAANNPTMVAMTQITKKMLASKDKAEELYPVNPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETTGDWRRKQCRCPRWA

SEQ ID NO: 128 - protein, 395 aa, Zea mays; identical to SEQ ID NO: 126

SEQ ID NO: 129 - protein, 398 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMQNCPRIFPQKSRLAAAMSALRKPKYNGKCMRSLIRSILGETRVSETLTNVIIPAFDIRLLQPIIFSTYDAKSTPLKNALLSDVCIGTSAAPTYLPAHYFQTEDANGKEREYNLIDGGVAANNPTMVAMTQITKKMLASKDKAEELYPVNPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETREVRTGDWRRKQCRCPRWAR

SEQ ID NO: 130 - protein, 398 aa, Zea mays; identical to SEQ ID NO: 129

SEQ ID NO: 131 - protein, 384 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMQNCPRIFPQKSRLAAAMSALRKPKYNGKCMRSLIRSILGETRVSETLTNVIIPAFDIRLLQPIIFSTYDAKSTPLKNALLSDVCIGTSAAPTYLPAHYFQTEDANGKEREYNLIDGGVAANNPTMVAMTQITKKMLASKDKAEELYPVNPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETKGGTNR

SEQ ID NO: 132 - protein, 383 aa, Zea mays
MASYSSRRPCNTCSTKAMAGSVVGEPVVLGQRVTVLTVDGGGVRGLIPGTILAFLEARLQELDGPEARLADYFDYIAGTSTGGLITAMLTAPGKDKRPLYAAKDINHFYMQNCPRIFPQKSRLAAAMSALRKPKYNGKCMRSLIRSILGETRVSETLTNVIIPAFDIRLLQPIIFSTYDAKSTPLKNALLSDVCIGTSAAPTYLPAHYFQTEDANGKEREYNLIDGGVAANNPTMVAMTQITKKMLASKDKAEELYPVNPSNCRRFLVLSIGTGSTSEQGLYTARQCSRWGICRWLRNNGMAPIIDIFMAASSDLVDIHVAAMFQSLHSDGDYLRIQDNSLRGAAATVDAATPENMRTLVGIGERMLAQRVSRVNVETGGTNR

SEQ ID NO: 133 - protein, 396 aa, Zea mays; identical to SEQ ID NO: 123

SEQ ID NO: 134 - protein, 396 aa, Zea mays; identical to SEQ ID NO: 123

SEQ ID NO: 135 - protein, 395 aa, Zea mays; identical to SEQ ID NO: 126

SEQ ID NO: 136 - protein, 437 aa, Sorghum bicolor
MATYYSSRRPCNACSTKAMAGSVVGEPVVLGQRVTVLTVDGGGIRGLIPGTILAFLEARLQELDGPEVRLADYFDYIAGTSTGGLITAMLTAPGKDRRPLYAAKDINQFYMENCPRIFPQKSSRLAAAMSALRKPRYNGKCLRNLIMSMLGETRVSDTLTNVIIPTFDVRLLQPIIFSTYDAKSMPLKNALLSDVCIGTSAAPTYLPAHYFQTKDAGSGKEREYNLIDGGVAANNPTMVAMTQITKKMLASKEKAEELYPVKPWNCRKFLVLSIGTGSTSEQGLYTARQCSRWGICRWIRNNGMAPIIDIFMAASSDLVDIHVAAMFQSLHSDGDYLRIQDNSLHGAAATVDAATPENMRTLVGIGERMLAQRVSRVNVETGRYEPVPGEGSNADALAGIARQLSEERRTRLARRTSAIVSSGGASRRTCASKVSNV

SEQ ID NO: 137 - protein, 421 aa, Setaria italica
MASYSSRRPCNACRTKAMAGSVVGEPVVPGQRVTVLTIDGGGIRGLIPGTILAFLEARLQELDGPEARLADYFDCIAGTSTGGLITAMITTPGEDKRPLFAARDINRFYFDNCPRIFPQSRSSLAAAMSALRKPRYNGKYLRSTIRSMLGETRVSDALTNVVIPTFDIKLIQPIIFSTYDVKNMPLKNALLSDVCISTSAAPTYLPAHYFQIQDAGGKTREYNLIDGGVAANNPTMVAMTQITKMMLAKDKEELYPVKPEDCRKFLVLSIGTGSTSDEGLFTARQCSRWGVVRWLRNNGMAPIIDIFMAASSDLVDIHAAVLFQSLHSDGHSLRGAAATVDAATPENMRTLVGIGERMLAQRVSRVNVETGRYEPVPGEGSNADALVALARQLSDERRARIARRAAAACAGGSRCCSPVKT

SEQ ID NO: 138 - protein, 422 aa, Hordeum vulgare
MASYWCRRPCESCSTRAMAGSVVGQPVAPGQRVTVLTIDGGGIRGLIPGTILAFLEARLQELDGPDARLADYFDCIAGTSTGGLITAMLTAPGQDGRPLFAAKDVNRFYLDNGPYIFPQRRCALAAVTASLRRPRYSGKYLHGKIRSMLGETRLCDALTDVVIPTFDVKLLQPIIFSTYDARNMPLKNARLADICIGTSAAPTYLPAHHFHTQDDNGKEREYNLIDGGVAANNPTMVTMTQITKKMMVKDREELYPVKPSDCGKFLVLSIGTGSTSDQGLYTAKQCSQWGIIRWLRNKGMAPIIDIFMAASSDLVDIHAAVLFQSLHSDGNYLRIQDNSLHGPAATVDAATPENMAELLRIGERMLAQRVSRVNVETGRYEEIRGAGSNADALAGFAKQLSDERRTRLGRRRVGAGRLKSRR

SEQ ID NO: 139 - protein, 423 aa, Brachypodium distachyon
MASYACRRPCESCRTRAMAGGVVGEPTTPGQRVTVLTIDGGGIRGLIPGTILAFLEDRLQELDGPDARLADYFDCIAGTSTGGLITAMITAPGEEGRPLFAAEDINRFYLDNGPQIFPQKRSSLMSVLASLTRPRYNGKFLHGKIRSMLGETRVCDTLTDVVIPTFDVRLLQPIIFSTYDAKSMPLKNALLSDVCISTSAAPTFLPAHYFQTEDDNGKVREYNLIDGGVAANNPTMVAMTQITKKIMAKDKEELYPVKPSDCGKFLVLSIGTGSTSDQGLYTAKQCSRWGIIRWLRNKGMAPIIDIFMAASSDLVDIHAAVLFQSLHSDGDCYLRIQDNSLRGAAATVDTATPDNMRELVRIGERMLAQRVSKVNVETGRYEEMQGAGTNADALAGFARQLSDERRARFGPRDGAPANGKSRC

SEQ ID NO: 140 - protein, 414 aa, Oryza sativa
MAGCVVGEPASAPGQRVTLLAIDGGGIRGLIPGTILAFLEARLQELDGPDARLADYFDCIAGTSTGGLITAMLAAPGDHGRPLFAASDINRFYLDNGPRIFPQKRCGMAAAMAALTRPRYNGKYLQGKIRKMLGETRVRDTLTNVVIPTFDVRLLQPTIFSTYDAKSMPLKNALLSDICISTSAAPTYLPAHCFQTTDDATGKVREFDLIDGGVAANNPTMVAMTQITKKIMVKDKEELYPVKPSDCGKFLVLSLGTGSTSDQGMYTARQCSRWGIVRWLRNKGMAPIIDIFMAASSDLVDIHAAVMFQSLHSDGDYLRIQDNTLHGDAATVDAATRDNMRALVGIGERMLAQRVSRVNVETGRYVEVPGAGSNADALRGFARQLSEERRARLGRRNACGGGGEGEPSGVACKR

SEQ ID NO: 141 - protein, 275 aa, Triticum aestivum
MLGETRLSDALTDVVIPTFDVKLLQPIIFSTYDAKSMPLKNARLADVCIGTSAAPTYLPAHHFHTHDGNGKEREYNLIDGGVAANNPTMVAMTQITKKMMGKDREELYPVEPSDCGKFLVLSVGTGSTSDQGLYTAKQCSQWGIISWLRNKGMAPIIDIFMAASSDLVDIHAAVLFQSLHSDANYLRIQDNSLHGPAATVDAATPENMAELLRIGERMLAQRVSRVNVETGRYEEVKGAGNNADALAGFARQLSDERRTRLGSRRGGAGRLKSSR

SEQ ID NO: 142 - protein, 416 aa, Musa acuminata
MASDQTPPATADAPISTPPPSFGKRVTVLCIDGGGVRGLIPATIIAFLEAELQKLDGPEARIADYFDVIAGTSTGGLVTAMLTAPNKEKRPLFAAKDIVQFYLDNSPKIFPQKNAGLFNSALNLVGAVSGPKYDGKYLHAIIRQLLGDTRLSQTLTNVVIPTFDIKFLQPTIFSTYQTKSTPLKDALLSDICIGTSAAPTYLPGHYFETKDDNGNKRSFNLVDGGVAANNPTLTAMTEVSKEILLSNPDFFSYQPVEYDRFLVISLGTGAPKQEEKFTAQESAKWGVLGWLLNKGTTPLIDIFTQASADMVDIHASVLFQALNKGKNYLRIEDDTLTGQTSSVDVSTKKNLQDLVDIGNSLLKKPVSRVNIETGHSEAVDGEGTNEAALTGFAKKLSDEKRRRQSKQLTSSDATQH

SEQ ID NO: 143 - protein, 402 aa, Elaeis guineensis
MGSNESPVANPPPCKGKVVTILSIDGGGVRGIIPGTILEFLEAKLQELDGPDARIADYFDIIAGTSTGGLVTTMLTAPNKDNRPLFSAKDIIQFYLENCPKIFPQRTGLLAGALNLFGAVSGPKYDGKFLHSKVKELLGDTKLHQTLTNIVIPAFDIKLLQPVIFSTFETKTDPSKDALLSDICISTSAAPTYLPAHYFETKDSQGKTRSFNLVDGGVAANNPMLIATSQITKQIFWNNEDFSKFKPTDFAKFLVVSLGTGSPKQEQKFTAPESAKWGLLGWLQNKGSTPIIDIFSQSSADMVDIHASILFQALRSEKNYLRIQDDTLEGDTASVDVSTSENLRKLVQVGQDLLKKPVSRVNLETGVSEACDVEGTNEDALIRFAKMLSNERKSRNAKMSAA

SEQ ID NO: 144 - protein, 407 aa, Arabidopsis thaliana
MQMDSPKSPLQPPTYGNLVTILSIDGGGIRGLIPAVILGFLESELQKLDGEEARLADYFDVIAGTSTGGLVTAMLTAPNKEGRPLFAASEIKDFYLEQCPKIFPQDHFPFSAAKKLVKSLTGPKYDGKYLHQLIHAKLGDTKLSQTLTNVVIPTFDIKHLQPTIFSSYEVKNHPLKDAALADIAISTSAAPTYLPAHFFKVEDLNGNAKEYNLIDGGVAANNPALLAIGEVTNEISGGSSDFFPIRPNDYGRFLVLSLGTGNHKAEEKFNAKEVAGWGLLNWLTHDNSTPIIDAFSQASSDMVDFHLSAVFRALHSEANYIRIQDDTLTGDAASVDIATVENLDILAKTGDELLKKPVARVNLDSGCNENAYETTNEHALIKLAGILSKEKKIRDIRSPHAKAPIRI

What is claimed is:
1. A cDNA comprising SEQ ID NO: 70 or a sequence 95% identical to SEQ ID NO: 70.

* * * * *